US012435337B2

(12) United States Patent
Whitmore et al.

(10) Patent No.: US 12,435,337 B2
(45) Date of Patent: Oct. 7, 2025

(54) INHIBITORS OF EXPRESSION AND/OR FUNCTION

(71) Applicant: E-Therapeutics PLC, London (GB)

(72) Inventors: Alan Victor Whitmore, Bath (GB); Julie Borgel, London (GB); Amy McCarthy, Cambridge (GB); Graham Craggs, Bicester (GB); James Longden, Maidenhead (GB); Ines De Santiago, London (GB); Duncan Brown, Berkeley, CA (US); Ahmad Ali Mortazavi, London (GB); Viviana Mannella, London (GB); Muthusamy Jayaraman, Cambridge, MA (US); Alexandre Debacker, London (GB); Adrian Mogg, Blackwater (GB)

(73) Assignee: E-Therapeutics PLC, London (GB)

( * ) Notice: Subject to any disclaimer, the term of this patent is extended or adjusted under 35 U.S.C. 154(b) by 0 days.

(21) Appl. No.: 18/640,905

(22) Filed: Apr. 19, 2024

(65) Prior Publication Data

US 2024/0336922 A1 Oct. 10, 2024

Related U.S. Application Data

(63) Continuation of application No. PCT/EP2023/064762, filed on Jun. 1, 2023.

(60) Provisional application No. 63/369,627, filed on Jul. 27, 2022.

(30) Foreign Application Priority Data

Jun. 1, 2022 (GB) .................................... 2208124
Feb. 6, 2023 (EP) .................................... 23155118

(51) Int. Cl.
*C12N 15/11* (2006.01)
*C12N 15/113* (2010.01)

(52) U.S. Cl.
CPC ...... *C12N 15/1137* (2013.01); *C12N 2310/14* (2013.01); *C12N 2310/322* (2013.01); *C12N 2310/351* (2013.01)

(58) Field of Classification Search
CPC .................................................. C12N 2310/14
See application file for complete search history.

(56) References Cited

U.S. PATENT DOCUMENTS

2015/0119279 A1 4/2015 Wong

FOREIGN PATENT DOCUMENTS

WO 2009062199 A1 5/2009
WO 2009/079452 A2 6/2009
WO 2012/177639 A2 12/2012
WO 2018226560 A1 12/2018
WO 2019/193144 A1 10/2019
WO 2021/216325 A1 10/2021
WO 2023232983 A1 12/2023

OTHER PUBLICATIONS

Chen, Y. et al. (2021, e-pub. Dec. 9, 2020). "Galactosyltransferase B4GALT1 Confers Chemoresistance in Pancreatic Ductal Adenocarcinomas by Upregulating N-Linked Glycosylation of CDK11p110," Cancer Letters 500:228-243.

Chowdhury, U.F. et al. (2021, e-pub. Dec. 13, 2020). "A Computational Approach to Design Potential siRNA Molecules as a Prospective Tool for Silencing Nucleocapsid Phosphoprotein and Surface Glycoprotein Gene of SARS-CoV-2," Genomics 113(1):331-343.

International Search Report and Written Opinion mailed on Sep. 4, 2023, for International Application No. PCT/EP2023/064762, filed on Jun. 1, 2023, 14 pages.

Li, S.-F. et al. (2018, e-pub. Feb. 7, 2018). "Downregulation of β1, 4-Galactosyltransferase 5 Improves Insulin Resistance by Promoting Adipocyte Commitment and Reducing Inflammation," Cell Death & Disease 9(196): 14 pages.

Liu, J. et al. (2013, e-pub. Jul. 24, 2013). "RNA Duplexes With Abasic Substitutions Are Potent and Allele-Selective Inhibitors of Huntingtin and Ataxin-3 Expression," Nucleic Acids Research 41(18):8788-8801.

Mahajan, A. et al. (Nov. 2018, e-pub. Dec. 10, 2018). "Fine-Mapping of an Expanded Set of Type 2 Diabetes Loci to Single-Variant Resolution Using High-Density Imputation and Islet-Specific Epigenome Maps," Nature Genetics 50(11):1505-1513, 29 pages.

Manoharan, M. (2004, e-pub. Oct. 22, 2004)."RNA Interference and Chemically Modified Small Interfering RNAs," Current Opinion in Chemical Biology 8(6):570-579.

Montasser, M.E. et al. (Dec. 3, 2021). "Genetic and Functional Evidence Links a Missense Variant in B4GALT1 to Lower LDL and Fibrinogen," Science 374:1221-1227, 7 pages.

Wei, Y. et al. (2008, e-pub. Sep. 26, 2008). "Identification of β-1, 4-Galactosyltransferase I as a Target Gene of HBx-Induced Cell Cycle Progression of Hepatoma Cell," Journal of Hepatology 49:1029-1037.

De Vitis, C. et al. (Nov. 9, 2019). "B4GALT1 Is a New Candidate to Maintain the Stemness of Lung Cancer Stem Cells," Journal of Clinical Medicine 8(1928):1-16.

Zhou, H. et al. (Nov. 2012). "B4GALT1 Gene Knockdown Inhibits the Hedgehog Pathway and Reverses Multidrug Resistance in the Human Leukemia K562/Adriamycin-Resistant Cell Line," IUBMB Life 64(11):889-900.

*Primary Examiner* — Ekaterina Poliakova-Georgantas
(74) *Attorney, Agent, or Firm* — MORRISON & FOERSTER LLP

(57) ABSTRACT

The present invention relates to inhibitors, and compositions containing inhibitors, and uses of the same in the treatment or prevention of diabetes.

19 Claims, 28 Drawing Sheets

Specification includes a Sequence Listing.

FIG. 6 (from Sentences 1 ~ 101 ~ linker 1)
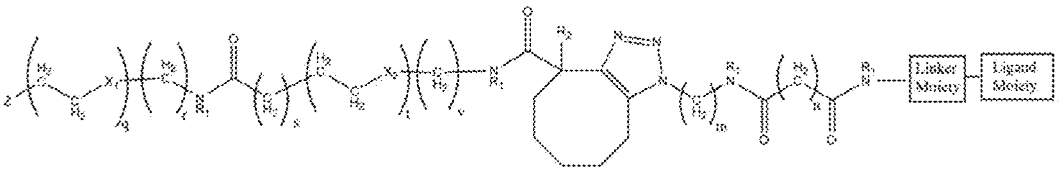
Formula (I)
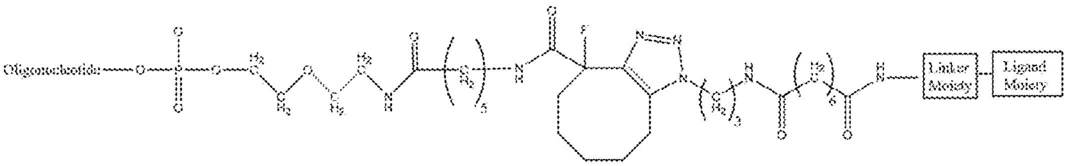
Formula (II)
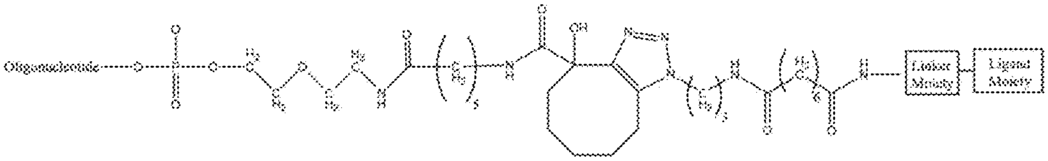
Formula (III)
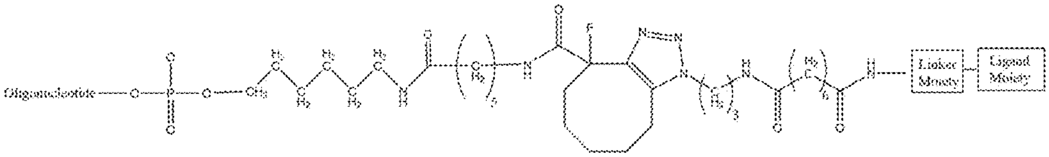
Formula (IV)

FIG. 6 (cont.) (from Sentences 1 – 101 – linker 1)
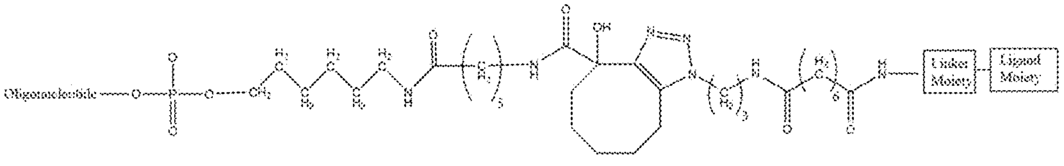
Formula (V)
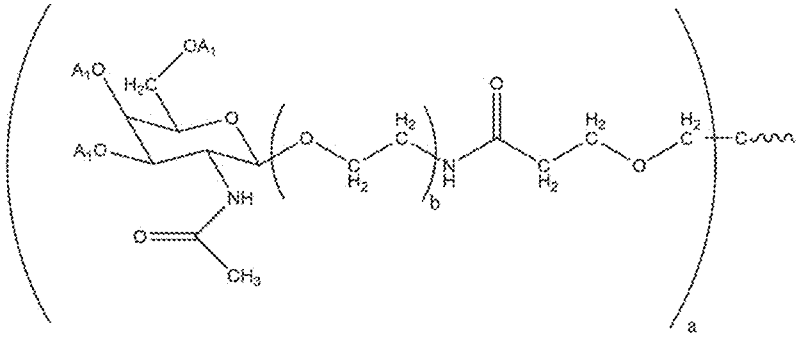
Formula (VIa)
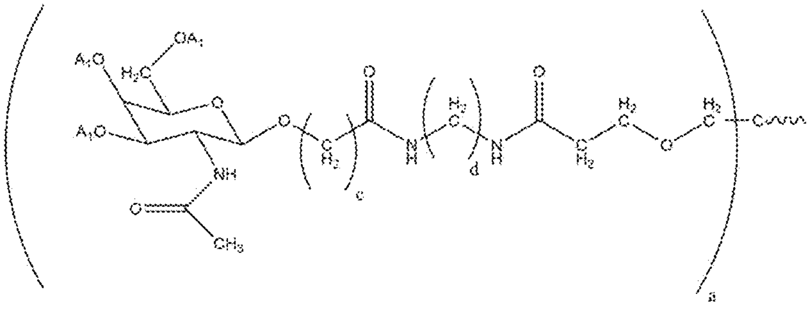
Formula (VIb)

FIG. 6 (cont.) (from Sentences 1 - 101 - linker 1)
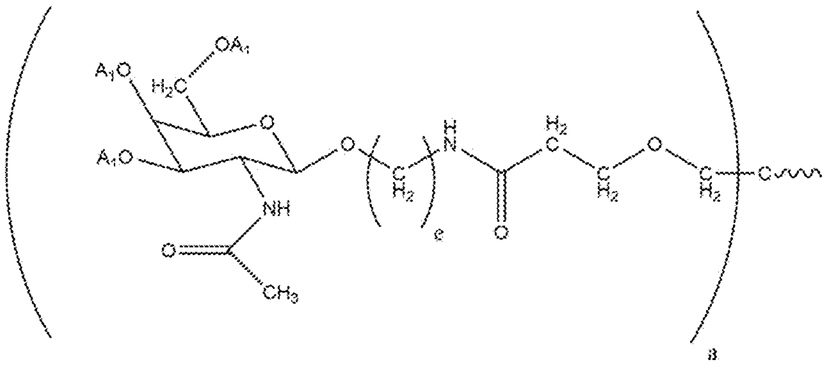
Formula (VIc)
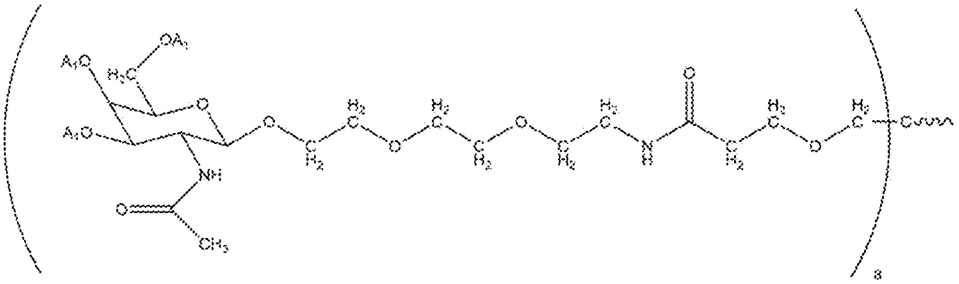
Formula (VII)
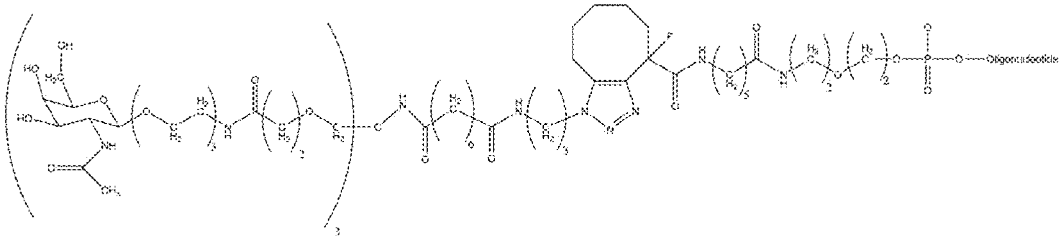
Formula (VIII)

FIG. 6 (cont.) (from Sentences 1 – 101 – linker 1)
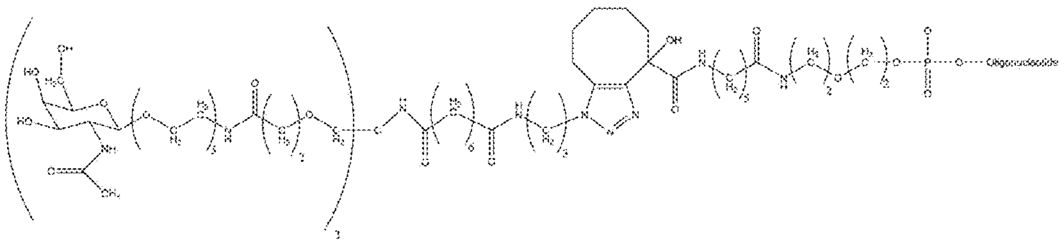
Formula (IX)
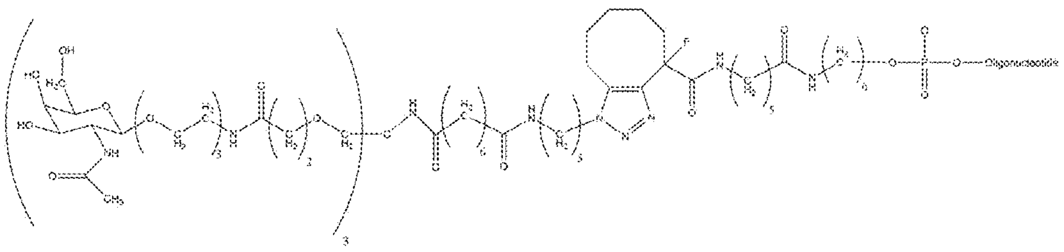
Formula (X)
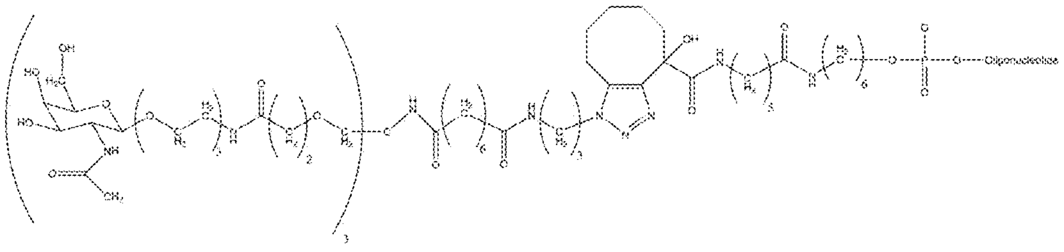
Formula (XI)
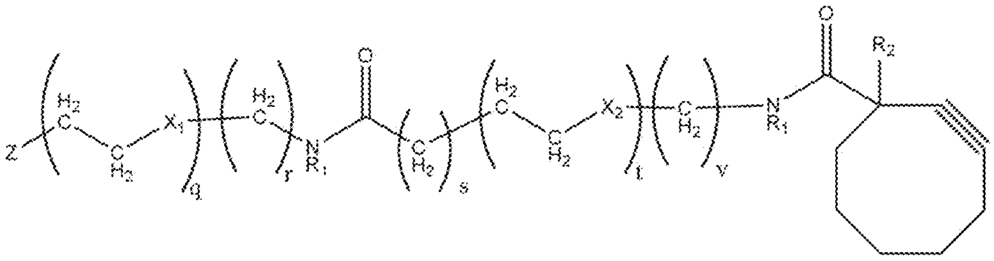
Formula (XII)

FIG. 6 (cont.) (from Sentences 1 – 101 – linker 1)
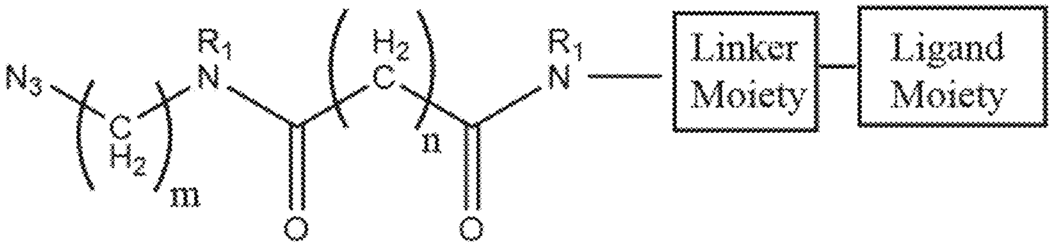
Formula (XIII)
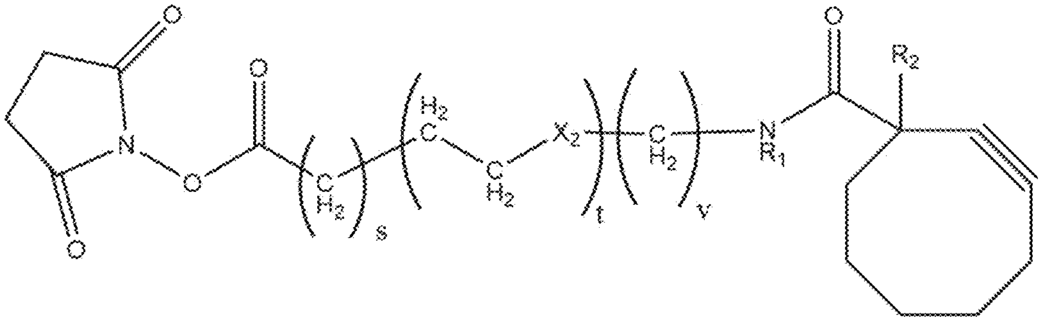
Formula (XIV)
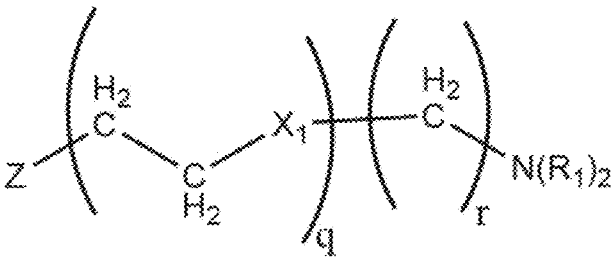
Formula (XV)

FIG. 6 (cont.) (from Sentences 1-101 – linker 1)
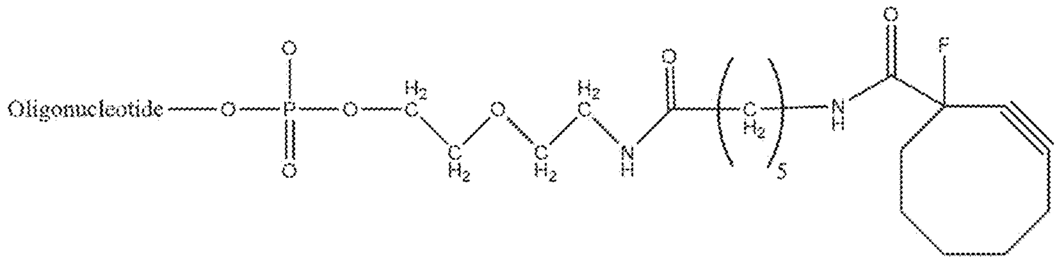
Formula (XIIa)
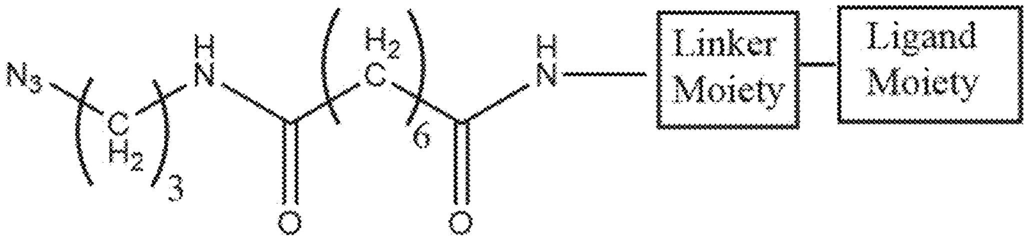
Formula (XIIIa)
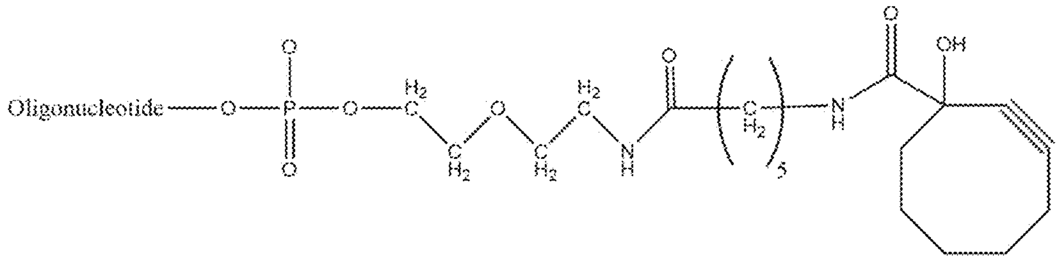
Formula (XIIb)

FIG. 6 (cont.) (from Sentences 1-101 – linker 1)
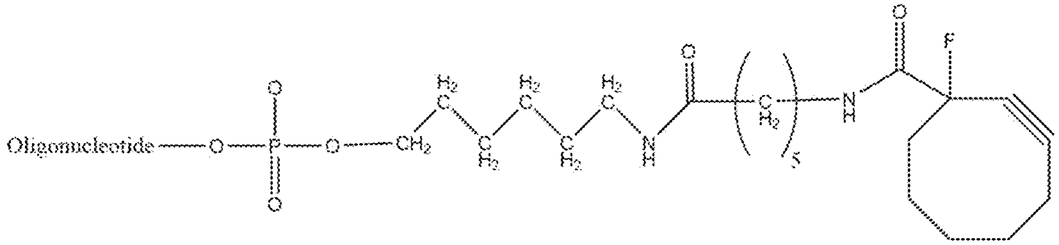
Formula (XIIc)
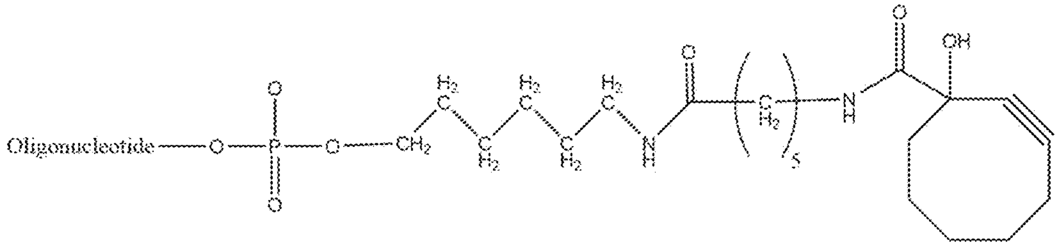
Formula (XIId)
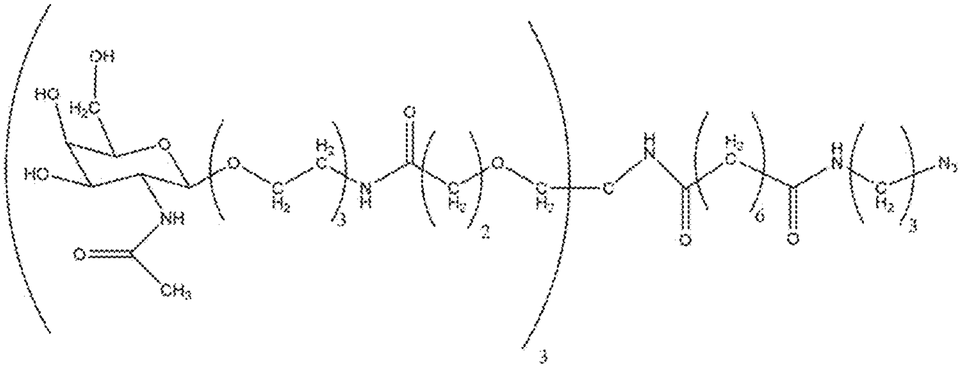
Formula (XIIIb)

FIG. 6 (cont.) (from Sentences 1-101 – linker 1)
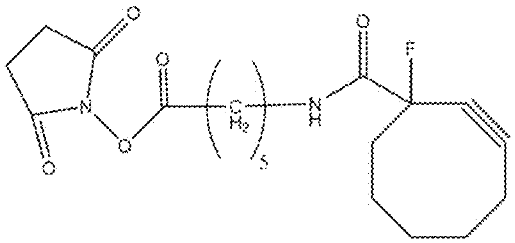
Formula (XIVa)
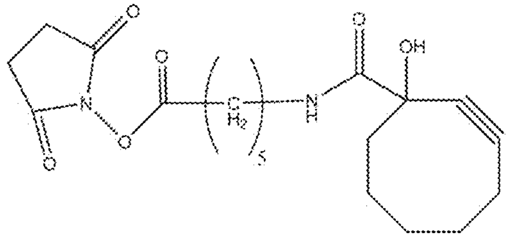
Formula (XIVb)
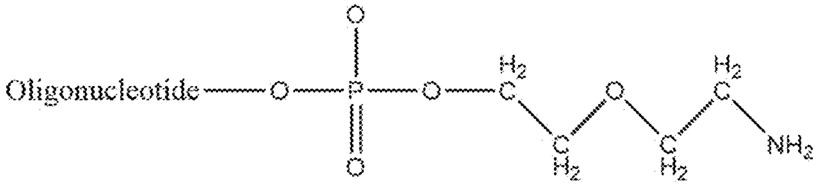
Formula (XVa)
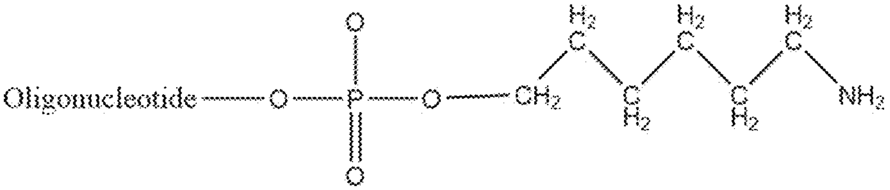
Formula (XVb)

FIG. 7 (Formulae from Clauses 1 - 56)
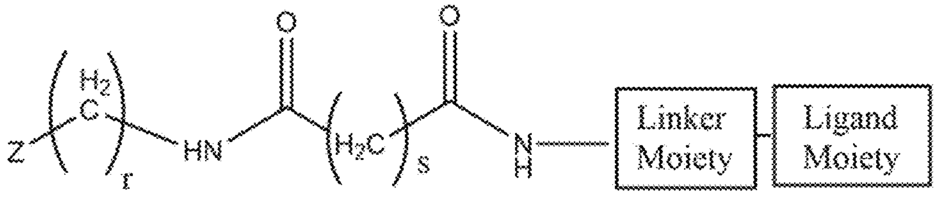
Formula (I*)
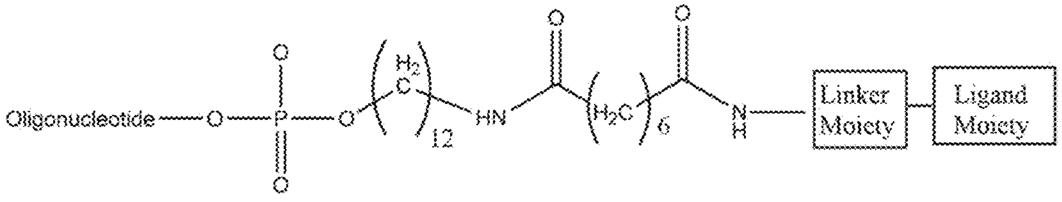
Formula (II*)
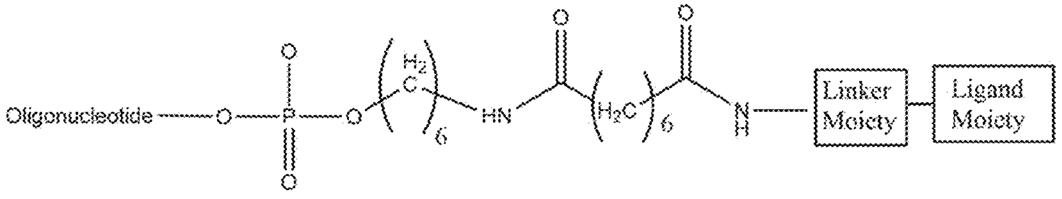
Formula (III*)

FIG. 7 (cont.) (Formulae from Clauses 1 - 56)
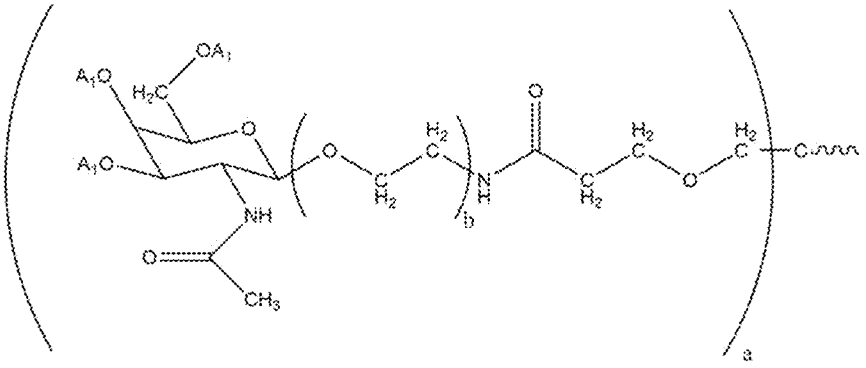
Formula (IV*)
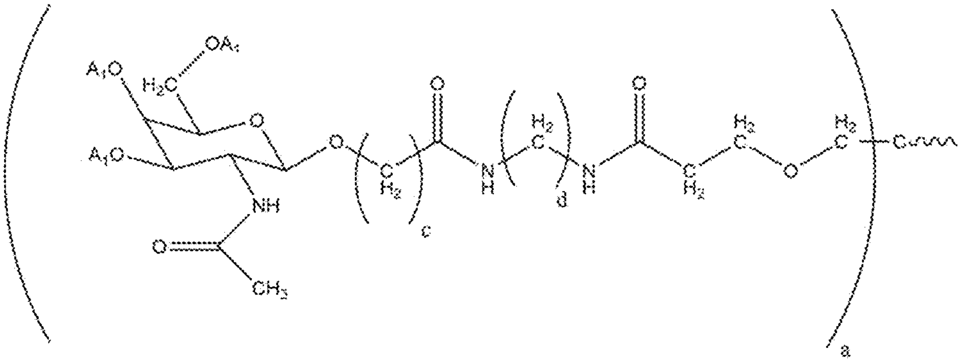
Formula (V*)
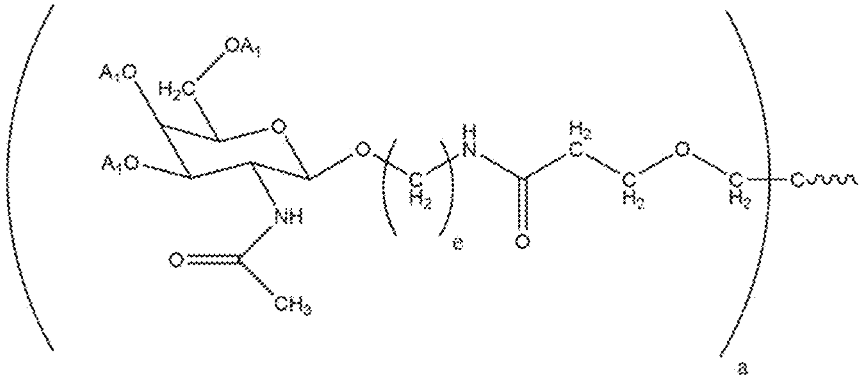
Formula (VI*)

FIG. 7 (cont.) (Formulae from Clauses 1 - 56)
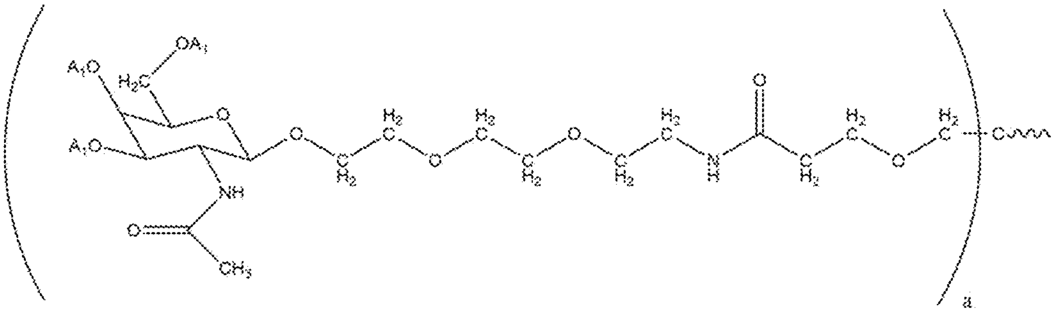
Formula (VII*)
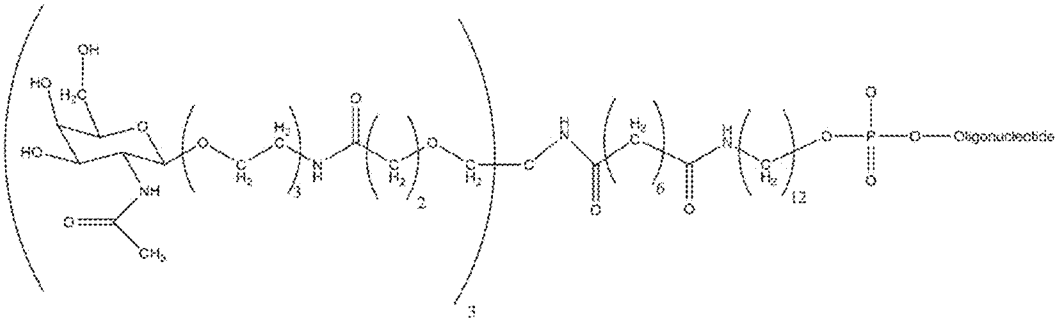
Formula (VIII*)
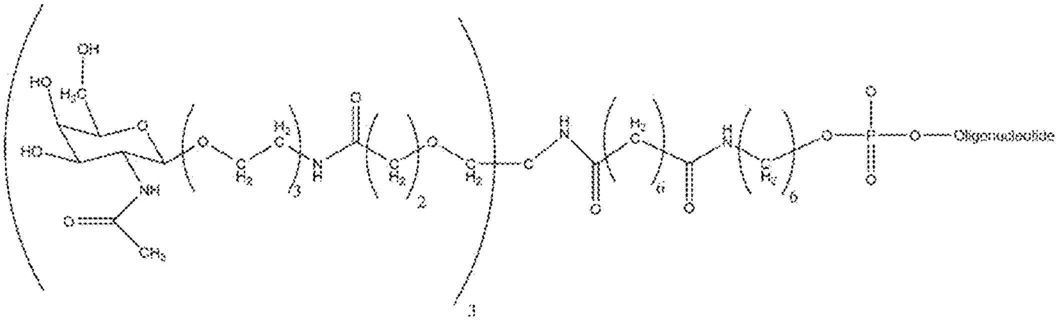
Formula (IX*)

FIG. 7 (cont.) (Formulae from Clauses 1 - 56)
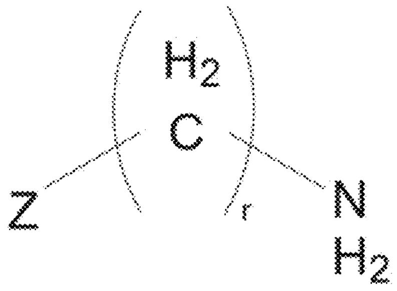
Formula (X*)
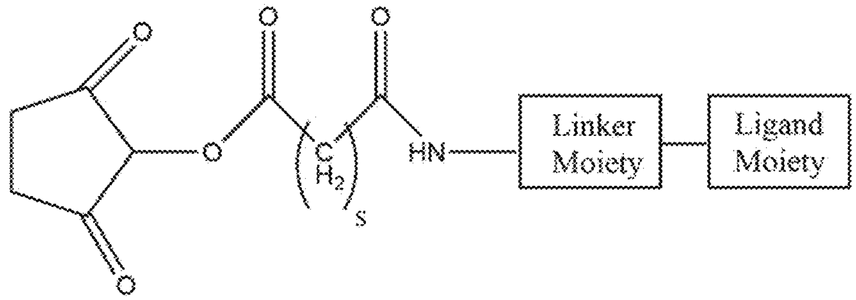
Formula (XI*)
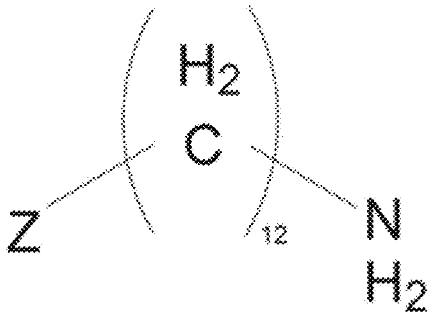
Formula (Xa*)

FIG. 7 (cont.) (Formulae from Clauses 1 - 56)
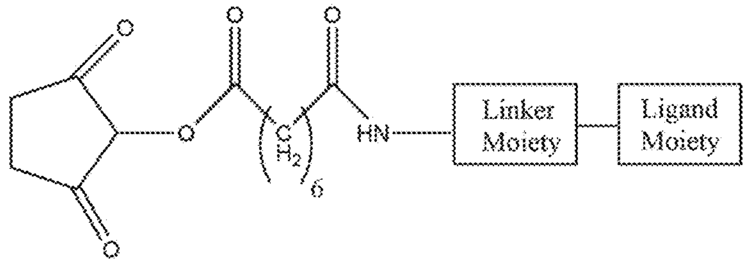
Formula (XIa*)
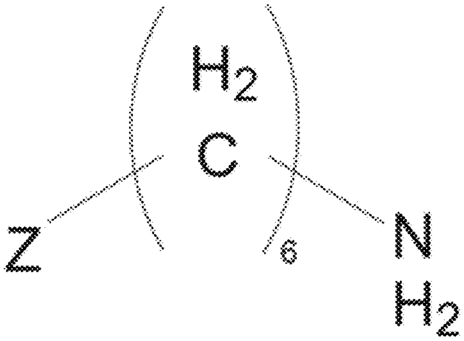
Formula (Xb*)
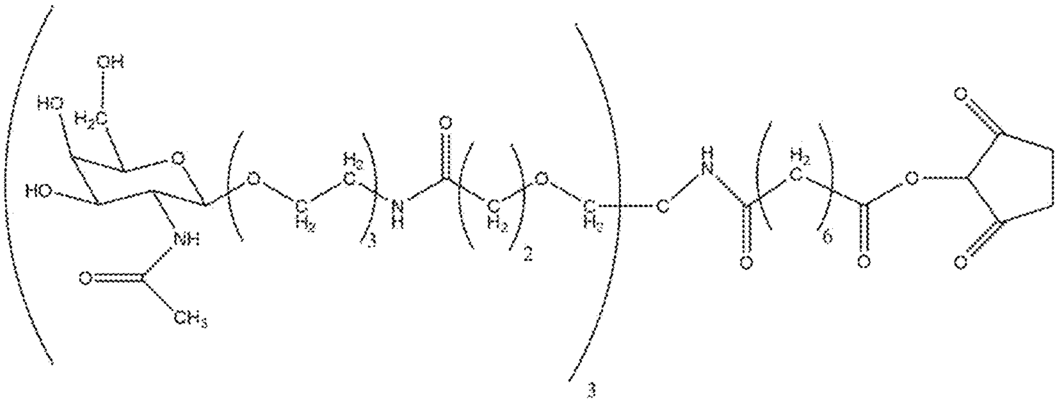
Formula (XIb*)

INHIBITORS OF EXPRESSION AND/OR FUNCTION

CROSS REFERENCE TO RELATED APPLICATIONS

This application is Continuation of International Application No. PCT/EP2023/064762, filed internationally on Jun. 1, 2023, which claims the priority benefit of European Application No. 2208124.4, filed on Jun. 1, 2022, U.S. Provisional Patent Application No. 63/369,627, filed on Jul. 27, 2022, and European Application No. 23155118.5, filed on Feb. 6, 2023, the contents of each of which are incorporated herein by reference in their entirety.

REFERENCE TO AN ELECTRONIC SEQUENCE LISTING

The contents of the electronic sequence listing (228792001001SUBSEQLIST3.xml; Size: 3,601,732 bytes; and Date of Creation: Oct. 1, 2024) is herein incorporated by reference in its entirety.

FIELD

The present invention provides inhibitors, such as nucleic acid compounds, such as siRNA, suitable for therapeutic use. Additionally, the present invention provides methods of making these compounds, as well as methods of using such compounds for the treatment of various diseases and condition.

BACKGROUND OF THE INVENTION

Inhibitors, such as oligonucleoside/oligonucleotide compounds which are inhibitors of gene expression and/or expression or function of other targets such as LNCRNAs, can have important therapeutic applications in medicine. Oligonucleotides/oligonucleosides can be used to silence genes that are responsible for a particular disease. Gene-silencing prevents formation of a protein by inhibiting translation. Importantly, gene-silencing agents are a promising alternative to traditional small, organic compounds that inhibit the function of the protein linked to the disease. siRNA, antisense RNA, and micro-RNA are oligonucleoside/oligonucleotides that prevent the formation of proteins by gene-silencing.

A number of modified siRNA compounds in particular have been developed in the last two decades for diagnostic and therapeutic purposes, including siRNA/RNAi therapeutic agents for the treatment of various diseases including central-nervous-system diseases, inflammatory diseases, metabolic disorders, oncology, infectious diseases, and ocular diseases.

The present invention relates to inhibitors, such as oligomers e.g. nucleic acids, e.g. oligonucleoside/oligonucleotide compounds, and their use in the treatment and/or prevention of disease.

In particular, suitable inhibitors are still needed to help in the prevention and or treatment of diseases such as type 2 diabetes.

A mutation in the B4GALT1 gene resulting in a serine at the position corresponding to position 352 of the full length/mature B4GALT1 polypeptide has been identified as being associated with a reduced risk of coronary artery disease (see WO2018226560, and Montasser et al., Science 374, 1221-1227 (2021) 3 Dec. 2021). The use of an siRNA that hybridizes to a sequence within the endogenous B4GALT1 gene and decreases expression of B4GALT1 polypeptide in a cell in a subject has been proposed as a means to treat a subject with, or susceptible to, developing cardiovascular conditions.

STATEMENTS OF INVENTION

The invention is defined as in the claims and relates to, inter alia:

In one aspect, the invention relates to an inhibitor of post-translational glycosylation, such as an inhibitor of expression and/or function of B4GALT1, wherein said inhibitor is conjugated to one or more ligand moieties.

In a further aspect, the invention relates to an inhibitor according to the invention, wherein said inhibitor comprises an siRNA oligomer conjugated to one or more ligand moieties.

In a further aspect, the invention relates to an inhibitor according to the invention, wherein said one or more ligand moieties comprise one or more GalNAc ligands.

In a further aspect, the invention relates to an inhibitor according to the invention, wherein said one or more ligand moieties comprise one more GalNAc ligand derivatives.

In another aspect, the invention relates to an inhibitor of post-translational glycosylation for use in the treatment of diabetes, such as an inhibitor of expression and/or function of B4GALT1.

In another aspect, the invention relates to an inhibitor of expression and/or function of B4GALT1 for use in the treatment of diabetes.

In a further aspect, the invention relates to an inhibitor for use according to the invention, which is an siRNA oligomer, typically conjugated to one or more ligand moieties.

In a further aspect, the invention relates to an inhibitor for use according to the invention, wherein said one or more ligand moieties comprise one or more GalNAc ligands, and/or one or more GalNAc ligand derivatives.

In a further aspect, the invention relates to an inhibitor or an inhibitor for use according to the invention, wherein the target of the inhibitor is selected from B4GALT1.

In a further aspect, the invention relates to an inhibitor or an inhibitor for use according to the invention, which is an siRNA oligomer having a first and a second strand wherein:

i) the first strand of the siRNA has a length in the range of 15 to 30 nucleosides, preferably 19 to 25 nucleosides, more preferably 23 or 25; even more preferably 23; and/or ii) the second strand of the siRNA has a length in the range of 15 to 30 nucleosides, preferably 19 to 25 nucleosides, more preferably 21 nucleosides.

In a further aspect, the invention relates to an inhibitor or an inhibitor for use according to the invention, wherein the second sense strand further comprises one or more abasic nucleosides in a terminal region of the second strand, and wherein said abasic nucleoside(s) is/are connected to an adjacent nucleoside through a reversed internucleoside linkage.

In a further aspect, the invention relates to an inhibitor or an inhibitor for use according to the invention, wherein the second strand comprises:

i 2, or more than 2, abasic nucleosides in a terminal region of the second strand; and/or ii 2, or more than 2, abasic nucleosides in either the 5' or 3' terminal region of the second strand; and/or iii 2, or more than 2, abasic nucleosides in either the 5' or 3' terminal region of the second strand, wherein the abasic nucleosides are present in an overhang as herein described; and/or iv 2, or more than 2, consecutive abasic nucleosides in a terminal region of the second strand, wherein preferably one such abasic nucleoside is a terminal nucleoside; and/or v 2, or more than 2, consecutive abasic nucleosides in either the 5' or 3' terminal region of the second strand, wherein preferably one such abasic nucleoside is a terminal nucleoside in either the 5' or 3' terminal region of the second strand; and/or vi a reversed internucleoside linkage connects at least one abasic nucleoside to an adjacent basic nucleoside in a terminal region of the second strand; and/or vii a reversed internucleoside linkage connects at least one abasic nucleoside to an adjacent basic nucleoside in either the 5' or 3' terminal region of the second strand; and/or viii an abasic nucleoside as the penultimate nucleoside which is connected via the reversed linkage to the nucleoside which is not the terminal nucleoside (called the antepenultimate nucleoside herein); and/or ix abasic nucleosides as the 2 terminal nucleosides connected via a 5'-3' linkage when reading the strand in the direction towards that terminus;

x abasic nucleosides as the 2 terminal nucleosides connected via a 3'-5' linkage when reading the strand in the direction towards the terminus comprising the terminal nucleosides;

xi abasic nucleosides as the terminal 2 positions, wherein the penultimate nucleoside is connected via the reversed linkage to the antepenultimate nucleoside, and wherein the reversed linkage is a 5-5' reversed linkage or a 3'-3' reversed linkage; xii abasic nucleosides as the terminal 2 positions, wherein the penultimate nucleoside is connected via the reversed linkage to the antepenultimate nucleoside, and wherein either (1) the reversed linkage is a 5-5' reversed linkage and the linkage between the terminal and penultimate abasic nucleosides is 3'5' when reading towards the terminus comprising the terminal and penultimate abasic nucleosides; or (2) the reversed linkage is a 3-3' reversed linkage and the linkage between the terminal and penultimate abasic nucleosides is 5'3' when reading towards the terminus comprising the terminal and penultimate abasic nucleosides.

In a further aspect, the invention relates to an inhibitor or an inhibitor for use according to the invention, wherein the reversed internucleoside linkage is at a terminal region which is distal to the 5' terminal region of the second strand, or at a terminal region which is distal to the 3' terminal region of the second strand.

In a further aspect, the invention relates to an inhibitor or an inhibitor for use according to the invention, wherein the reversed internucleoside linkage is a 3'3 reversed linkage.

In a further aspect, the invention relates to an inhibitor or an inhibitor for use according to the invention, wherein the reversed internucleoside linkage is a 5'5 reversed linkage.

In a further aspect, the invention relates to an inhibitor or an inhibitor for use according to the invention, wherein one or more nucleosides on the first strand and/or the second strand is/are modified, to form modified nucleosides.

In a further aspect, the invention relates to an inhibitor or an inhibitor for use according to the invention, wherein the modification is a modification at the 2'-OH group of the ribose sugar, optionally selected from 2'-Me or 2'-F modifications.

In a further aspect, the invention relates to an inhibitor or an inhibitor for use according to the invention, wherein the first strand comprises a 2'-F at any of position 14, position 2, position 6, or any combination thereof, counting from position 1 of said first strand.

In a further aspect, the invention relates to an inhibitor or an inhibitor for use according to the invention, wherein the second strand comprises a 2'-F modification at position 7 and/or 9, and/or 11 and/or 13, counting from position 1 of said second strand.

In a further aspect, the invention relates to an inhibitor or an inhibitor for use according to the invention, wherein the first and second strand each comprise 2'-Me and 2'-F modifications.

In a further aspect, the invention relates to an inhibitor or an inhibitor for use according to the invention, which is an siRNA, wherein the siRNA comprises at least one thermally destabilizing modification, suitably at one or more of positions 1 to 9 of the first strand counting from position 1 of the first strand, and/or at one or more of positions on the second strand aligned with positions 1 to 9 of the first strand, wherein the destabilizing modification is selected from a modified unlocked nucleic acid (UNA) and a glycol nucleic acid (GNA), preferably a glycol nucleic acid.

In a further aspect, the invention relates to an inhibitor or an inhibitor for use according to the invention, wherein the siRNA comprises at least one thermally destabilizing modification at position 7 of the first strand, counting from position 1 of the first strand.

In a further aspect, the invention relates to an inhibitor or an inhibitor for use according to the invention, which is an siRNA, wherein the siRNA comprises 3 or more 2'-F modifications at positions 7 to 13 of the second strand, such as 4, 5, 6 or 7 2'-F modifications at positions 7 to 13 of the second strand, counting from position 1 of said second strand.

In a further aspect, the invention relates to an inhibitor or an inhibitor for use according to the invention, which is an siRNA, wherein said second strand comprises at least 3, such as 4, 5 or 6, 2'-Me modifications at positions 1 to 6 of the second strand, counting from position 1 of said second strand.

In a further aspect, the invention relates to an inhibitor or an inhibitor for use according to the invention, which is an siRNA, wherein said first strand comprises at least 5 2'-Me consecutive modifications at the 3' terminal region, preferably including the terminal nucleoside at the 3' terminal region, or at least within 1 or 2 nucleosides from the terminal nucleoside at the 3' terminal region.

In a further aspect, the invention relates to an inhibitor or an inhibitor for use according to the invention, which is an siRNA wherein said first strand comprises 7 2'-Me consecutive modifications at the 3' terminal region, preferably including the terminal nucleoside at the 3' terminal region.

In a further aspect, the invention relates to an inhibitor or an inhibitor for use according to the invention, wherein the siRNA oligomer further comprises one or more phosphorothioate internucleoside linkages.

In a further aspect, the invention relates to an inhibitor or an inhibitor for use according to the invention, wherein said one or more phosphorothioate internucleoside linkages are respectively between at least three consecutive positions in a 5' or 3' near terminal region of the second strand, whereby said near terminal region is preferably adjacent said terminal region wherein said one or more abasic nucleosides of said second strand is/are located as defined herein.

In a further aspect, the invention relates to an inhibitor or an inhibitor for use according to the invention, wherein said one or more phosphorothioate internucleoside linkages are respectively between at least three consecutive positions in a 5' and/or 3' terminal region of the first strand, whereby preferably a terminal position at the 5' and/or 3' terminal region of said first strand is attached to its adjacent position by a phosphorothioate internucleoside linkage.

In a further aspect, the invention relates to an inhibitor or an inhibitor for use according to the invention, wherein the oligomer is an siRNA and the second strand of the siRNA is conjugated directly or indirectly to one or more ligand moiety(s), wherein said ligand moiety is typically present at a terminal region of the second strand, preferably at the 3' terminal region thereof.

In a further aspect, the invention relates to an inhibitor or an inhibitor for use according to the invention, wherein the ligand moiety comprises i) one or more GalNAc ligands; and/or
ii) one or more GalNAc ligand derivatives; and/or
iii) one or more GalNAc ligands and/or GalNAc ligand derivatives conjugated to said SiRNA through a linker.

In a further aspect, the invention relates to an inhibitor or an inhibitor for use according to the invention, wherein said one or more GalNAc ligands and/or GalNAc ligand derivatives are conjugated directly or indirectly to the 5' or 3' terminal region of the second strand of the siRNA oligomer, preferably at the 3' terminal region thereof.

In a further aspect, the invention relates to an inhibitor or an inhibitor for use according to the invention, wherein the ligand moiety comprises

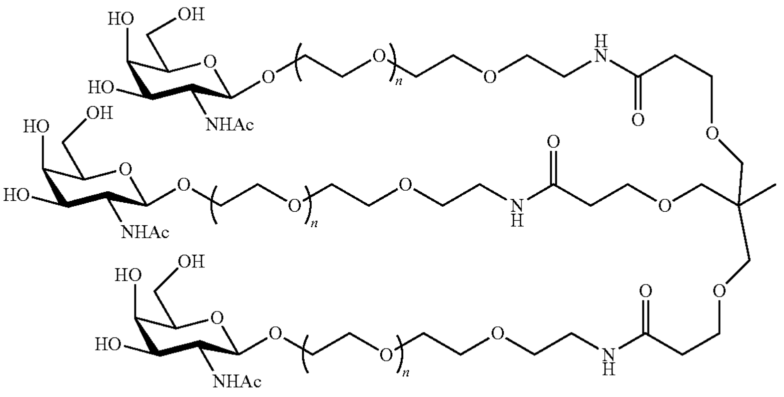

In a further aspect, the invention relates to an inhibitor or an inhibitor for use according to the invention, having the structure:

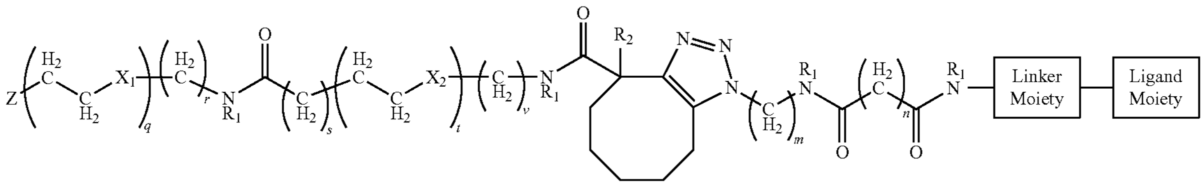

wherein:

$R_1$ at each occurrence is independently selected from the group consisting of hydrogen, methyl and ethyl;

$R_2$ is selected from the group consisting of hydrogen, hydroxy, —$OC_{1-3}$alkyl, —C(=O)$OC_{1-3}$alkyl, halo and nitro;

$X_1$ and $X_2$ at each occurrence are independently selected from the group consisting of methylene, oxygen and sulfur;

m is an integer of from 1 to 6;

n is an integer of from 1 to 10;

q, r, s, t, v are independently integers from 0 to 4, with the proviso that:

(i) q and r cannot both be 0 at the same time; and (ii) s, t and v cannot all be 0 at the same time;

Z is an oligomer

In a further aspect, the invention relates to an inhibitor or an inhibitor for use according to the invention, having the structure

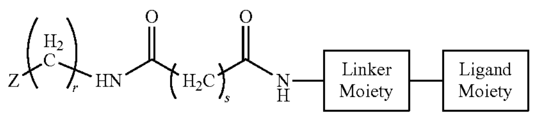

wherein:

r and s are independently an integer selected from 1 to 16; and

Z is an oligomer.

In a further aspect, the invention relates to an inhibitor or an inhibitor for use according to the invention, formulated as a pharmaceutical composition with an excipient and/or carrier.

In another aspect, the invention relates to a pharmaceutical composition comprising an inhibitor according to the invention, in combination with a pharmaceutically acceptable excipient or carrier.

In a further aspect, the invention relates to a pharmaceutical composition comprising an inhibitor according to the invention, in combination with a pharmaceutically acceptable excipient or carrier, for use in the treatment of diabetes.

In another aspect, the invention relates to a use of B4GALT1 as a target for identifying one or more therapeutic agents for the treatment of diabetes.

In another aspect, the invention relates to a method of treating or preventing diabetes, which comprises administering to a patient an inhibitor of post-translational glycosylation, such as an inhibitor of B4GALT1 such as an inhibitor as defined according to the invention.

In another aspect, the invention relates to B4GALT1 for use as a biomarker of diabetes.

In another aspect, the invention relates to B4GALT1 for use in an in vivo method of predicting susceptibility to diabetes, typically by monitoring the sequence and/or level of expression and/or function of B4GALT1 in a sample obtained from a patient.

In another aspect, the invention relates to a method of predicting susceptibility to diabetes, and optionally treating diabetes, in a patient, said method comprising:

(a) obtaining a sample from the patient, (b) detecting the sequence and/or expression and/or function of B4GALT1 in said sample obtained from the patient, (c) predicting susceptibility to diabetes, based on the sequence and/or expression and/or function of B4GALT1 in said sample obtained from the patient, (d) preferably administering to the diagnosed patient an effective amount of an inhibitor of B4GALT1.

In another aspect, the invention relates to a use of an inhibitor, or composition, according to the invention, in the preparation of a medicament for use in the treatment of diabetes.

FIGURES

FIG. 6 shows the detail of the formulae described in Sentences 1-101 disclosed herein.

FIG. 7 shows the detail of formulae described in Clauses 1-56 disclosed herein.

Figure 8:
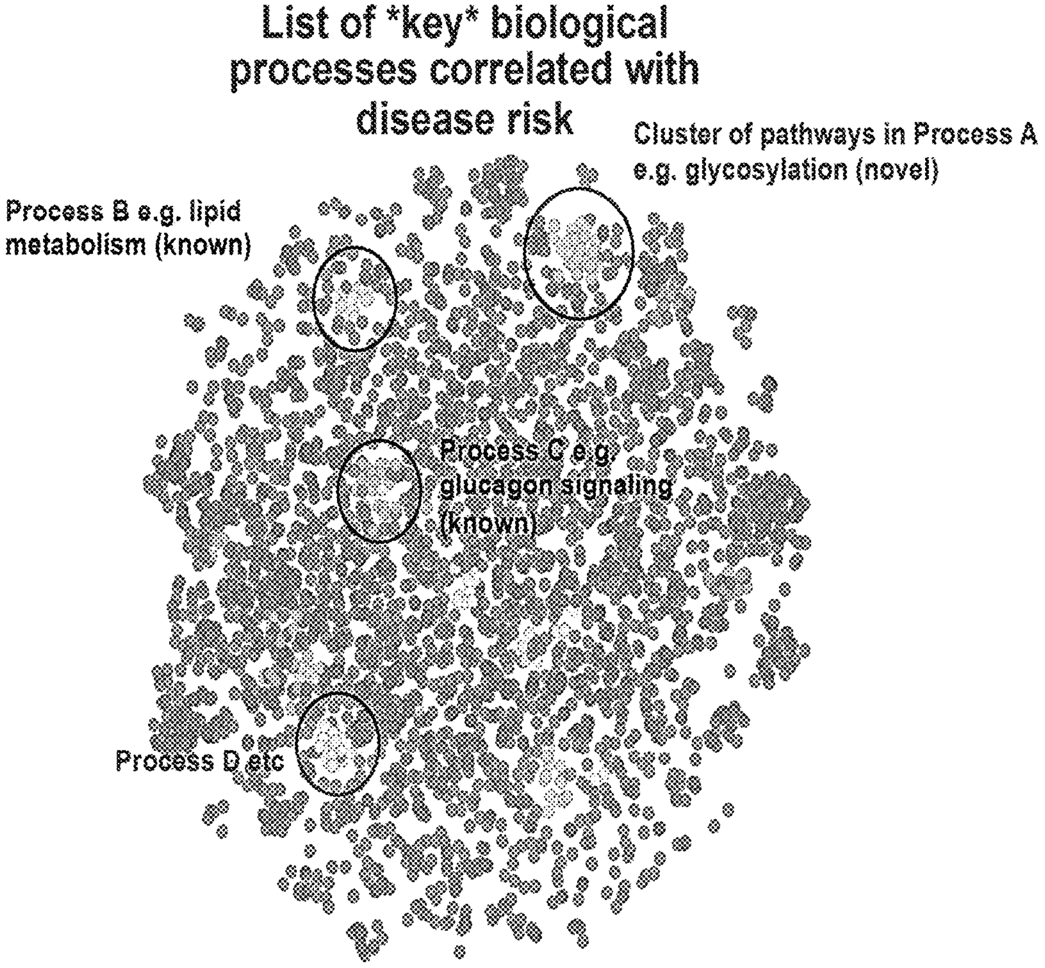

FIG. 8 shows a two-dimensional representation of the network-enriched pathways. Each pathway is represented by a point and the proximity of the points is a measure of the similarity of the pathways. Pathways sharing common proteins and/or neighbors are closer together—they cluster into higher order processes. The "network" relationship between pathways is used to identify common biological themes. This provides the basis for further analysis to create focused network models of key biology.

Figure 9:
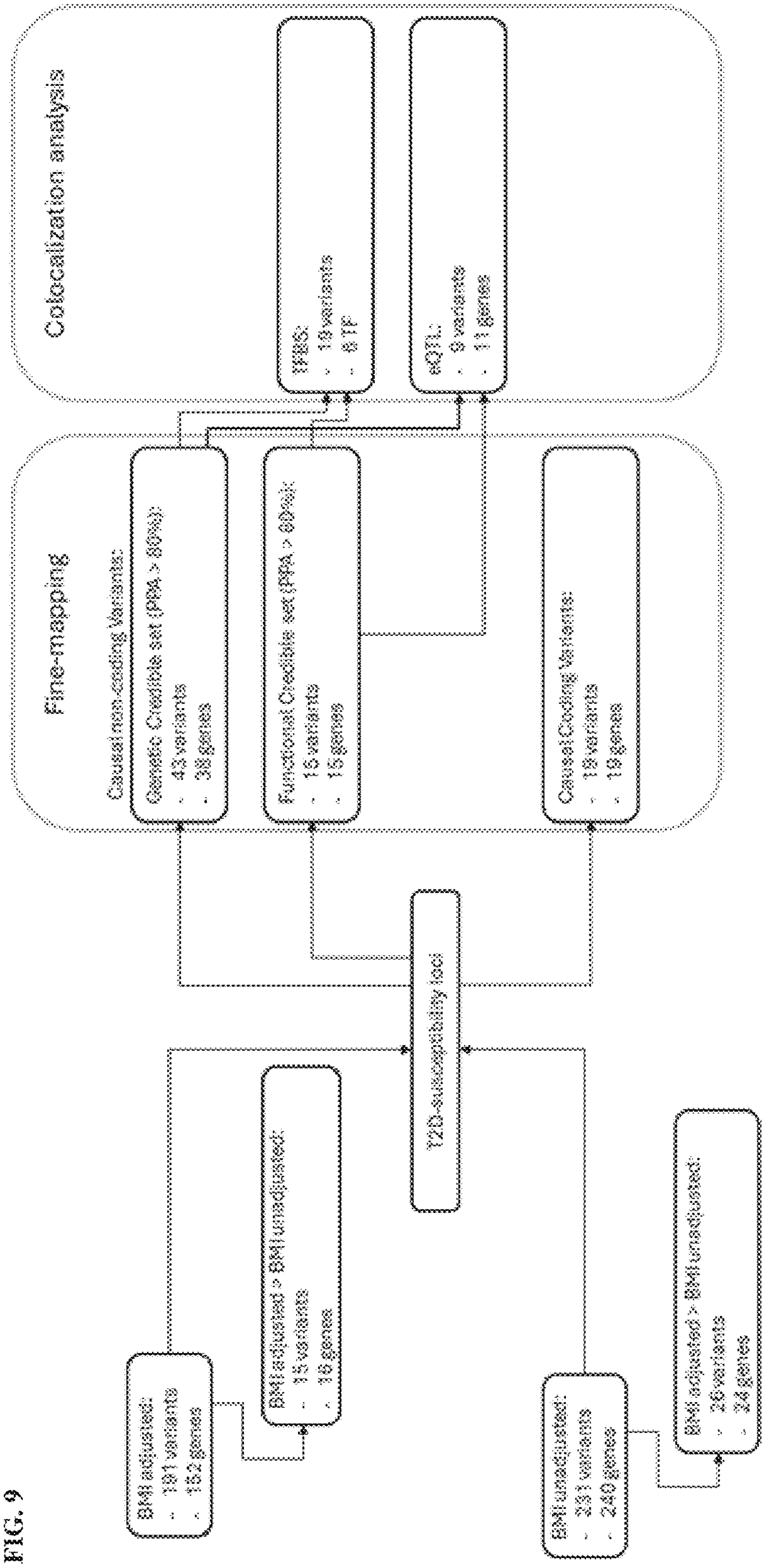
Figure 9:
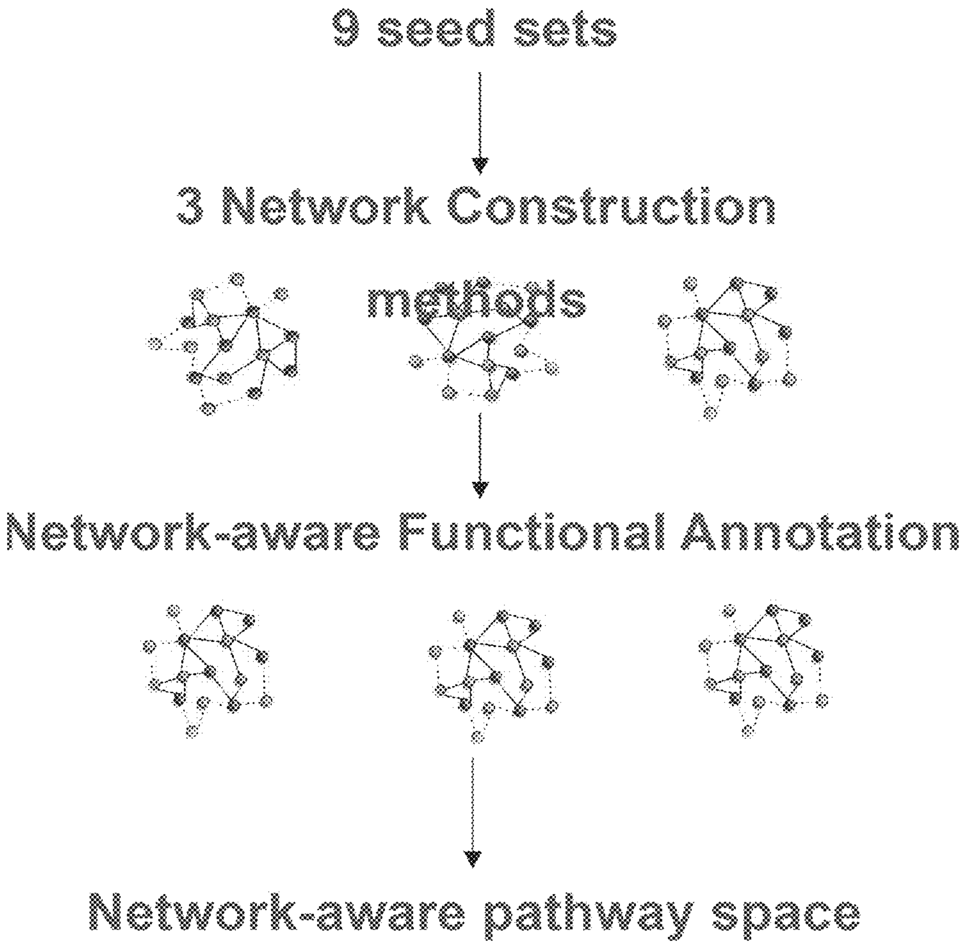

FIG. 9 is a summary diagram showing on top the analysis carried out by the meta-analysis authors and on the bottom the further analysis carried out by the inventors. The 9 'seed' sets used for network construction on the right were derived from the categories of gene sets on the top.

Figure 10:
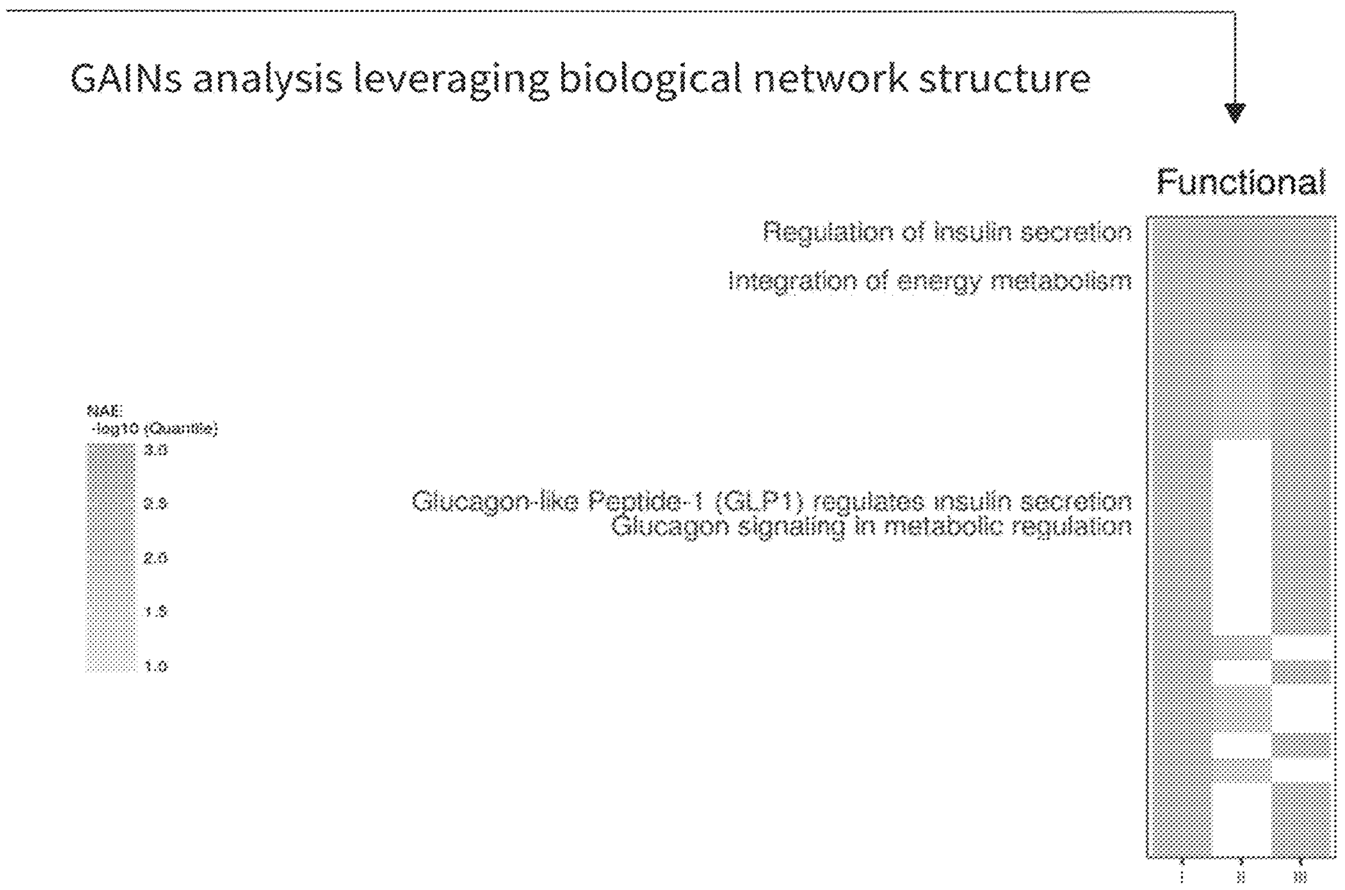

FIG. 10 illustrates the increased sensitivity of the network aware approach in identifying relevant biological processes—the data analysed using the inventor's approach is shown across 3 different network construction techniques—the inventors were able to resolve known processes in type 2 diabetes risk. A similar analysis yielded the novel risk-associated glycosylation process on which the inventors focused.

Figure 11:
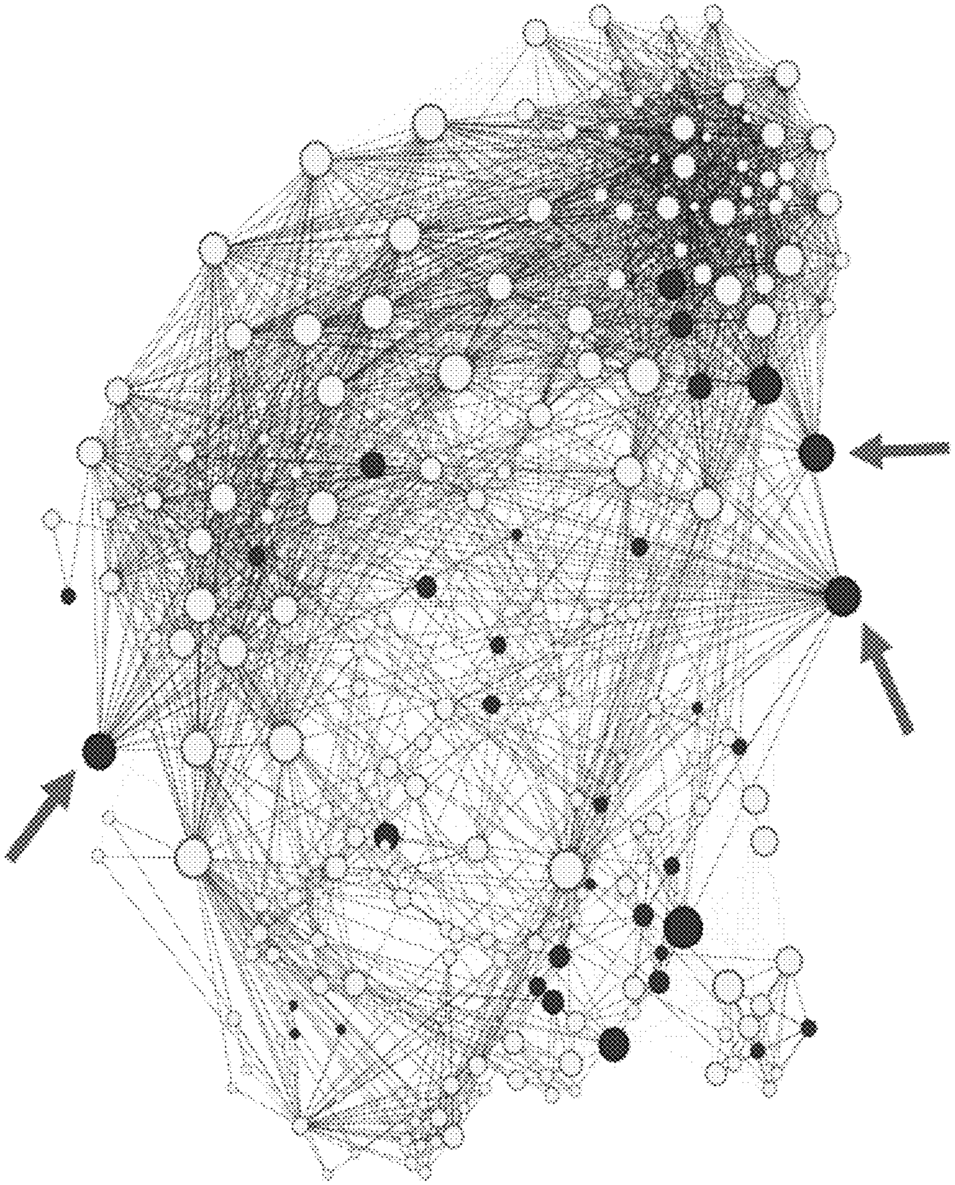

FIG. 11 is an illustration of the network model built with 3 key proteins highlighted by the inventor's analytics.

Figure 12:
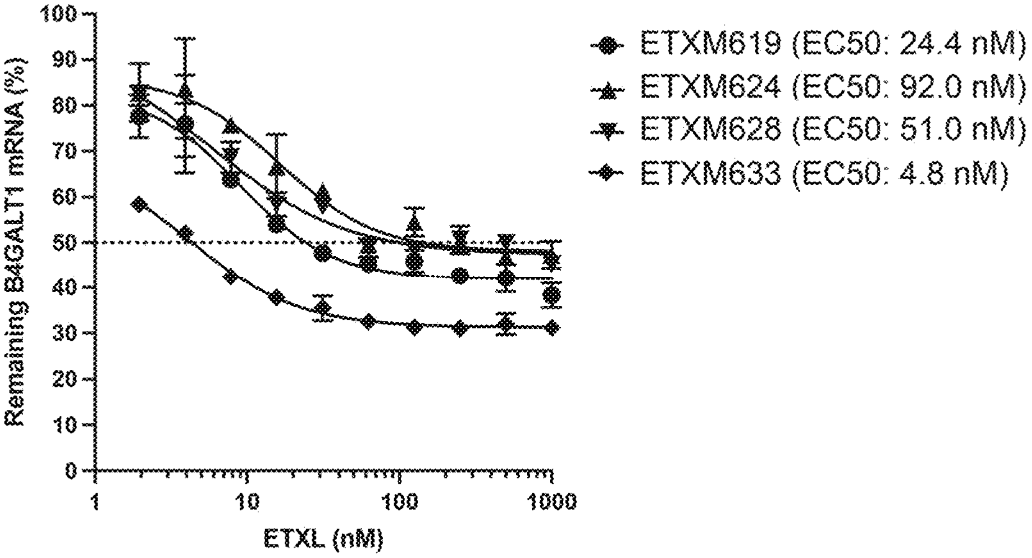

FIG. 12 shows a selection of active GalNAc-siRNAs with EC50 values less than 100 nM. Dose-response in B4GALT1 gene knockdown in primary mouse hepatocytes was measured after 48 hr incubation with GalNAc-siRNAs targeting mouse B4GALT1 at 10 serial dilutions from 1000 nM. $EC_{50}$ values were determined by fitting data to a 4-parameter sigmoidal dose-response (variable slope) equation using GraphPad Prism. 4 active GalNAc-siRNAs, ETXM619, ETXM624, ETXM628 and ETXM633, were selected for in vivo pharmacology.

Figure 13:
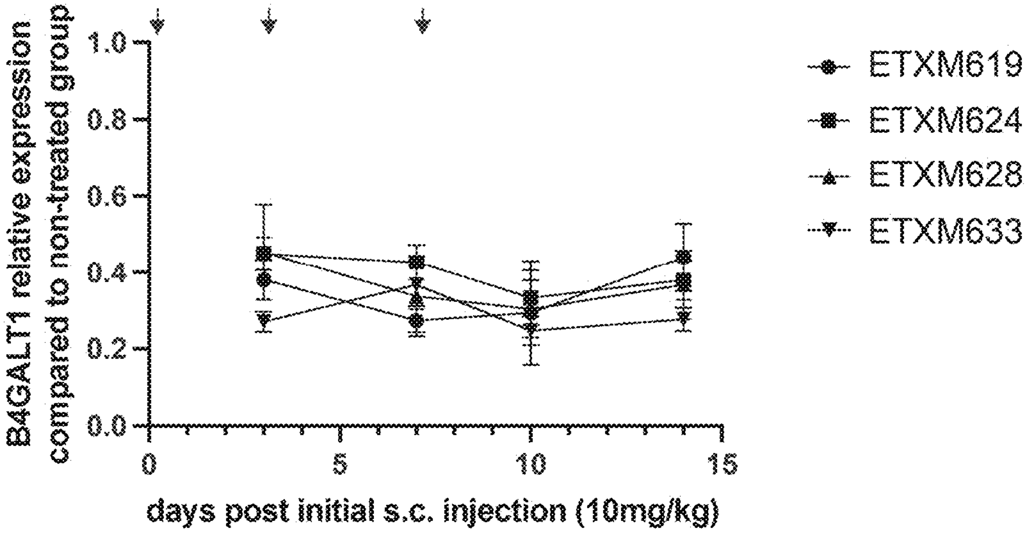

FIG. 13 is a summary of B4GALT1 mRNA knockdown effects of multiple dosing of GalNAc-siRNAs, ETXM619, ETXM624, ETXM628 and ETXM633 (10 mg/kg) in mouse liver tissues. The y-axis values are the relative mRNA expression to the non-treated group (n=5). Each data point represents the relative mRNA expression as Mean±SD from n=3 experiment. Red arrows on the top of the graph indicate the days test articles were administered.

Figure 14:
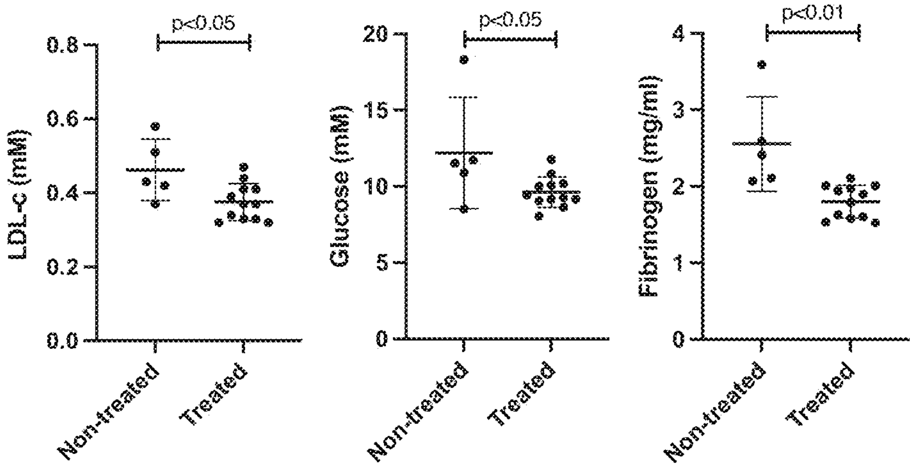

FIG. 14 shows the effect of B4GALT1 mRNA knockdown in plasma LDL-c, glucose and fibrinogen levels. Plasma samples were collected on day 14 after three dosings of ETXMs (10 mg/kg, s.c.) on day 0, day 3 and day 7. Compared to the non-treated group (n=5), the ETXM treated group (n=12) shows significantly reduced levels of LDL-c, glucose and fibrinogen in normal C57BL/6 mice. Data presented here are Mean±SD.

Figure 15A:
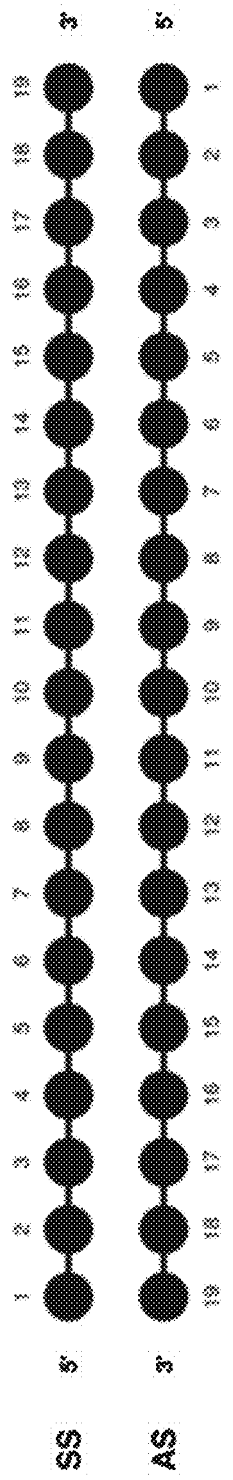
Figure 15B:
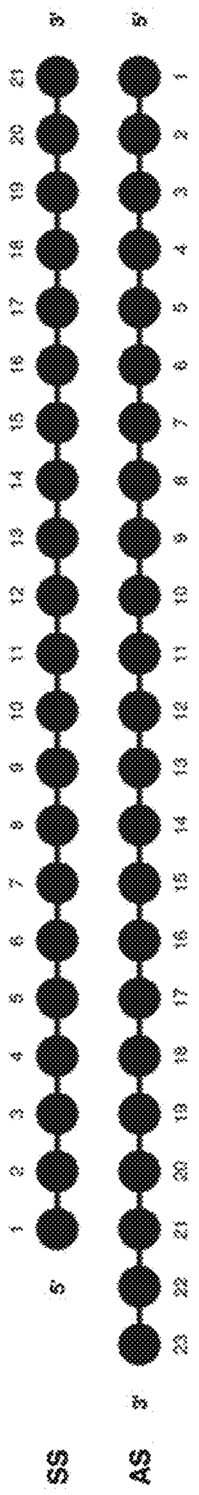

FIGS. 15A-15B show examples of duplex structures of a nucleic acid e.g. an siRNA of 19 base pairs in length.

DETAILED DESCRIPTION

The present invention provides, inter alia, inhibitors, for example oligomers such as nucleic acids, such as inhibitory RNA molecules (which may be referred to as iRNA or siRNA), and compositions containing the same which can affect expression of a target, for example by binding to mRNA transcribed from a gene, or by inhibiting the function of nucleic acids such as long non-coding RNAs (herein "LNCRNA"). The target may be within a cell, e.g. a cell within a subject, such as a human. The inhibitors can be used to prevent and/or treat medical conditions associated with the e.g. the expression of a target gene or presence/activity of a nucleic acid in a cell e.g. such as a long non-coding RNA.

In particular, the present invention identifies inhibitors of post translational glycosylation, such as an inhibitor of B4GALT1, as useful in the prevention and/or treatment of diabetes.

B4GALT1 is Beta-1,4-galactosyltransferase 1, an enzyme that in humans is encoded by the B4GALT1 gene (SEQ ID NO: 1).

```
Genomic DNA sequence comprising the B4GALT1 gene (SEQ ID NO: 1):
GAGGCATGAAGAAATAATTGTGCATGACTGAGGACTTTCCAGACCTCCCCTTTCC

TTCCACCAGTTACTTACTAATCTCAGAATCCACCCCCCAAAATTTTTCTGATAAAAACACTAC

CTTAAAGCCAGCCCAGGGAGACTTGAGCCAGCCCAGGGAGACCTAAAGTCACCACAGGGAG

ATTTCAGCTGGACTCTTCTATCTCCTTGTTGGCCTACCTGCAGTACAAAGCTTTTCTTTTCTCA

AAAACCAGGTGTCACAGTATTGGTTTCTAGAACATTGGGCAGTGAGTGCTTTTGCGCTTTGG

TCGGTAACACCTGGATCTGATTTAGACAATACTTTGGACCTGAAGTCTTAATTAGTTGAACTT

TTGGGGGATTTTAAGAAGACACTAATGTATTTTACCTGTGAGAAGAATCTAAATAATCTGTG

GCCATTGGGCAAACTACTGTGGAATAAAGGTGCCTGACAATTCTTTGTCCCTCCTCCCATCA

AGAGGTGGAGTCAGCCAGGTGAAATGGCTCATGCTGGTAATCTCAGCACTTTGGGAGGCCA

AAGCAGGAAGACTGCGTGAGCTCAGGAGTTCGAGACTAGCCTGAGCAATATCGCAACATCT

CATCTCTACTAAAAATTTTAAAATTAGCTGGACGTGGAGGCGCATCCCGGTAGTCCCAGCTA

CTCGGGAGGCTGAGGCAGGAGAATCACTTGAGCCCAGGAGTTTGACGTTATAGTGACCTAT

GATCACACCACTGCACTACAGGCTGGTTGATAAAGGAAGATCCTGTCTAAAAAAAAAAGTA

AAAACAAGAGGCCGAGCCAGTTTTATTCCCCTTGAATCTGGCCTGCCCTATAAACTTGTTTTA

AGCAAAAGAATGCTTTAGAAGTGATGCTAAGGCTGGGCTTTCAGGGATCTCCATCTTCTGTA

TTTTTGAAATGCTCCTTTTTGGAATGCTTCCTCTAGTTTGTGAGGAAACCCAAGCAGCCACAT

GGAGAGTCCTTTGTGGAGAGATCCAAGTGGAGAATGAAGGCCCCATGACCCAACCCATTCT

GAGTTTCCAGCCCCCAGACAGCCCCAACTGCCATTCACATGAGTGAAGCCATTTTGGAACTT

CCAACTGTGCCAGTGCCTCAGCTGACACCATGTGAGGCAAAGCTGCCCAGCCAACTGCAAA

ACTGCGAGAAATTGTTGCTTCAAAACAGTAAGTTTTGGGGTAGGTGTTACGCTGCAATAGAT

GACTGAAATAACTGTCTACCATGTGCCGGGCACTATTTGATGCCCTTCTGATCCATGAGGGT

AAAAACAGAAATGTAACCTGGCAGGTGCAGAAGAGGGCGCCATAGGAGGGCAGAGGAAGG

CCAGCTGCAGGGAGAAGCAGGGAGCTGGTGATTCTGGGCAGATGAGCACATGGATGGGCCA

ACGGCCAAGCCCCCATGCCAGCTTTTGGCCAATCAGCACTGCAACTTCCTCCTGCATTTGTCT

CGCCGGATGGGATTAATTTTTCACCTGACGAAGTAGAGAGTGGAAAAGAGCTGGAGACAGT

GGGGAGAAAGGTTGCCTGGGTCTGTCTCACTAGCACCAGTTAATGTCTGGACTGCTGGACAA

TGTTGTCCCAAAGGTTTCTGGGCCATCTGTATTATTTGTAATTGACTGCTTCTAGGTGCCTGT

GGATCAGGGGCAGCTGAGACTAGTGCTCAGGCCTCAGTGGACTCTGCAAGTTCCTGAGGGA

TAGGCAATCAGCAAGTGTTGTTCCTTTTCCTCGATTTCTGGCCACGTGTGTCCTGGGACAGGT

CTGTGATTCTTAATAACCCCCGCAGTCCTGTCTCCTGGCTATCATCTATACCAATGGAAGACA
```

-continued

CATCCCCATTTCCCCCTCCACTTAATTTTCAGTTGCAGGACTAATCTGACCCACCCTCACTCA

TTGGCCAGGCCGACTTTACCCCTAGACACAGGATGCTGGGGTCAGCTTCACCTTTACCAACT

CCTTGGAGAACTCCACTTTACGTTCTAAACTAAGTTAGCAATAATTTTTCCCTTCTCTCCTTCC

CACATCATTAAGATGATCACAGTATTTAAAAAGTATTTTAACAAATATCGGCCGGGCACGGT

GGCTCACAACTGTAATCCCAGCACTTTGGGAGGCCGAGGCAGGCAGATCACGAGGTCAAAA

GATTGAGACCATTCTGGATAACACGGTGAAACCCCATCTCTACTAAAAATACAAACAAATTA

GCCGGGCATGGTGGCAGGCACCTGTAGTCCCAGCTACTTGGGAGGCTGAGGCAGGAGAATG

GCGTGAACCCAGGAGGCAGAGCTTGCAGTGAGCCAAGATCACGCCACTGCACTCCAGCCTG

GGTGACAGAGTGAGACTCCGTCTCAAAAAAAAAAAAAAAAAATCTAGGGGCTGAAGATA

CAGTAGTGAACAAGAGAGAAATTTCCTGTTCTCATGAAGCTGATTTTCTAATGAGGGAGGCA

AGACAACAGAAAATAAATGCATAATGTTGGGTAGTTGATATCCACTCTGAAAAAAATCAAG

CAGGTTAAGGCCGGGCGCGGTGGCTCACGCCTGTAATCCCAGCACTTTGGGAGGCCGAGGC

GGGCGGATCACCTGAGGTCAGGAGTTTGAAACCAGCCTGGCCAACATGGTGAAATCCGTCT

CTACTAAAAACACAAAAAATTAGCCCGGCGTGATGGCAGGCACCTGTAATCCCAGCTACTC

AAGAGGCTGAGGCAGGAGAATCGCTTGAACCCGGGAGGCAGAGGTTGCAGTGAGGTGAGA

TTGCACCATTGCACTCCAACCTGGGGGACAAAAGCAAGACTTTGTCTCAAAAAAAAAAAA

AAAAAATTCAAGCAGTTTAAGCAGATTTGGGCAGGAGGCCATTCTGCATAAGGTAGTCTGA

AAAGGTCTCTGTCATAAGGTGACATTTAAGAGACCTGAATTGAATGAAATATTGGGGACAA

GTGTTTCAGGCTAAATGAACAGCAAGTACAAAGGCCCTGAGGCAGGAAGAAATATGGCAAG

TTCAAGGAATAGCTATCAGGCTAGTGTGGCTAAGGCAGGTCCAGCATGGTAGAGTGACAGA

TGTGGGTGGGGAGGGAAATAGGAACCAGATTGAACAGGGTTTCTGTGGATTTGGTTCTGAA

CAAAATGGCATGATCTGATTTATGCTTACAAAGATTTCCTGGATGCTCTGTGGAAAACAGAC

TAGGGAGGAGGAATGGAGGAGGTGGAAGCAGGGTGACCAATTAGTAGCTGCCATATAACCC

AGGGCAAGATGATGGTGGCTTGATCGAGGATGGTTACATCAGAGTTGGCTGGTGGTGAATTT

TGATGTTTTGAAGGTAGCACTGACAAAGCTGGCTGAGGGCTTGCAAATGGCATTGAGAGCA

AGAGAAGCACATCAAGGACACCTTTTAGATTCTGGGGAACTGAATAAACAATAGTATCACT

CTCTGAGGGAGGTAAGAACGGGAGTGGTGTGTAAGGAGTAGGTTGCTGAGGGCAAGATGTA

TTGTGTTTGAGATGCCAGTAAAATAAGCAGTTGAATCTGGAGGTCAGGGAAGAGATCTGGG

CTGGAGACAAATCAGTGATCAGCATTTGGATATTATAAATCATTCCGAGGCAGTAAGTGTAG

ACACAAAAGAACATCATGGACTATGGCTGGGGCCTTCAGCAACTGGGGAAGAAGTCCAGAG

AGGAGACAGAAATGGCCAGTGAAGTGAGGAAGATCAGAAGGACCTGGTGTCCAGGAAGTC

AAGTGAGGAAAGTTGATTCTGTATGATCACAACCAAAGTGTCAACTCATAAGCCTTATTTTC

TCATCTGTGAAATGGACACCGTAACACCACCTACTTCATGGCAGATAGTACTGGCACACAGC

AAACTCTCAAAATAAGGTAGCTACTGTTATTCCCTGATGGTTGGCTGCCAGAGCCCTCAACT

TCCCTATCCACATTACTGACAGCACCTCCATGAGTCTTTCTCTGGGGTGAGGTGTCTCTGCTC

ACTCAGGGCCTGAGGCCTCTGGGTCAAATCGAGGTCAAGTGGCTTCAGTGCCTAAGTCTCTC

ACCCACACAGCCTTCAGCCCTTACTTGCAAATCAACAAAGGGTAAACCTGTAGAAAACATG

GGTTTCGGAGCCAGAATTCTGCCTCTTGCCAGCTGTGGGCTCTTAGGAAAGTTTCTTAATCTG

CCGGGGCCCCACTCTACGACATGGGGAGAACTGCTACTTCATGGGACAGTGGGTAGCCCAG

TGTAGACTGTAACGCCGGCTGATCTCCTGCACGCTGGCCTGGGAGTTAGAGGCTTCTTGCTG

CTCTCCTCTTCAAAGTATACAGGACTCCCGCCACACACACATCTGGAACCAAGCTGGTCTGA

-continued

GAGCCCCTTATAGCCCAGGCTACCTGATGGGGAGGCACAGAAGTGGCAACCCGTCCACTTTC

TTTGCCGCAGGACCCCCCGTTAAGCAGCGGGGTCCAGCCGGGCTGAGTTAGGGAGGGGGTT

TCGAACGTGCCACTCCTCGCCCGGCGTCGAAGCCCGTTTCCTGGGTAACCTTTTTCTGCCTCT

CTTCCTAGCCCACCAAGGCCCACTGGCCAGAACGCCGCCGCGGCCCCAAACCACTCCAGATA

ACCACCCGCCAGCTGTCCTCTCCGTTCTCTCCGCCGCCGCGCTGCAGGCCCAGGCTCGCACC

CGAGTCCCTTCGCACCCCAGGAAGTGGCGCGGCCTGTCGAGGGCAGCGTGGAGGAGGAAGA

GGAGGCGCGGCTCAACGCGACCGAAGCTCCGCCGCAAAGGCTCGGGAGGAAGAGGGCGGT

GCGCGGCCAAGCGTCGGAGCTGCAGTCATACTCCGGGGACCCCACGACGGCGCCCCGCCCG

CTGCCCACCCTCCCGAGGCCCCGCCCAGCGCGCCCATCCCGCCACGGGCTGCCCCGCCTTCC

CGCCCTCGTCCAGAAAACCCCGCGCCCGGCCCCGCCCCCGCCTTCGCCGGGGCCCCGCCCCT

CCCCTCTCCGCCGGCGCCTCGGGCGGCTTCTCGCCGCTCCCAGGTCTGGCTGGCTGGAGGAG

TCTCAGCTCTCAGCCGCTCGCCCGCCCCCGCTCCGGGCCCTCCCCTAGTCGCCGCTGTGGGGC

AGCGCCTGGCGGGCGGCCCGCGGGCGGGTCGCCTCCCCTCCTGTAGCCCACACCCTTCTTAA

AGCGGCGGCGGGAAGATGAGGCTTCGGGAGCCGCTCCTGAGCGGCAGCGCCGCGATGCCAG

GCGCGTCCCTACAGCGGGCCTGCCGCCTGCTCGTGGCCGTCTGCGCTCTGCACCTTGGCGTC

ACCCTCGTTTACTACCTGGCTGGCCGCGACCTGAGCCGCCTGCCCCAACTGGTCGGAGTCTC

CACACCGCTGCAGGGCGGCTCGAACAGTGCCGCCGCCATCGGGCAGTCCTCCGGGGAGCTC

CGGACCGGAGGGGCCCGGCCGCCGCCTCCTCTAGGCGCCTCCTCCCAGCCGCGCCCGGGTGG

CGACTCCAGCCCAGTCGTGGATTCTGGCCCTGGCCCCGCTAGCAACTTGACCTCGGTCCCAG

TGCCCCACACCACCGCACTGTCGCTGCCCGCCTGCCCTGAGGAGTCCCCGCTGCTTGGTAAG

GACTCGGGTCGGCGCCAGTCGGAGGATTGGGACCCCCCCGGATTTCCCCGACAGGGTCCCCC

AGACATTCCCTCAGGCTGGCTCTTCTACGACAGCCAGCCTCCCTCTTCTGGATCAGAGTTTTA

AATCCCAGACAGAGGCTTGGGACTGGATGGGAGAGAAGGTTTGCGAGGTGGGTCCCTGGGG

AGTCCTGTTGGAGGCGTGGGGCCGGGACCGCACAGGGAAGTCCCGAGGCCCCTCTAGCCCC

AGAACCAGAGAAGGCCTTGGAGACTTCCCTGCTGTGGCCCGAGGCTCAGGAAGTTTTGGAG

TTTGGGTCTGCTTAGGGCTTCGAGCAGCCTTGCACTGAGAACTCTGGTAGGGACCTCGAGTA

ATCCACTCCCTTTTGGGGACTGACGTGAGGCTCCCGGTGGGGAAGGAGACTGACCTCTCGGT

TCACGTGTCTTGCCATAGAGCCACTCTCCTGAGTGGGTTTTTCTCCTGATCGTTTGGGCCAAG

TGACTTCTCTCTGAACCTCATATTTCTCTTCTGGGATAATAAATGGTCACCCTTTCAAGGGGT

TGTTTTGGAAGATATTGTGAACAATGGTAAATAAGGGCTTAATTAATGAGGGTAAGCCCTCA

GTAAATTGTCACTGTGTGTTCATTTCTTCCTCTGTGTGGATCGTGACCGAGAGCCCTTCCCCC

TAGCCTCCTCCTGGTATGGGTACCCAAAACCTAGGTGAGCAGGGATCTCTCCCAGGGGCAGA

GAGCTTGTGTACTCTGGGTGTTAGAGGGCTAAAATATAACCAGTCAACACCACGTTGCCCAT

TTCTGGTACTTCCGGTAGCAGCCTGAGTCTCAATTATCTTGCCCAGATGATCTGAACTCTGAC

CTCTAGCCTGTTTCAGCATAGGCAGAGAGCTTGAGTAGGTGAGTTTGCATTCCTCATAGCAG

CTGGCTGAGCCTAGTCTGGACTTCTCTTTGACCTGTAACCTACAGGCCCACAGGCCCAAGGC

AACCACAGGTTGCTTCCAGGGTTACCACACAGGTGGTTTCTCATTTCTAATGCTAGGTTTTAG

ATAATTGTTGTAAGTGAGGGGCCCTGGCAGGCAGGATGACATCCTGCCAATAGGAGTTTTCT

GTCACTTTCCCACAGAGCCCTGGCTACTACATACTCTTGCTCAATTTCGCCAGTAATTGCGTC

AATGTGTTCATATCAAGTTTGGGAAGAACATCTTGGAATTGGTCAGACGTGAACTGTGGTAA

-continued

TAATGGGGGCTTGTTTTTTTAAGCAGATAATTAAATTCCTTTGCATTTGATGATTATTCTGGG

AAGCAGACTAGTCCCATAAAATGAAATGGACTCTGCCTTGCTGCTAAGTGTCTGACTTGAGA

CATGCTATCGAGTTTCTCAAAATCTCTTCCTTGTGTAAAATGTGGTTGTCGATGATTACCTTA

CAGGGGTTTTTTAAGACTAAATGAGATCGTGTACATTAAATACAGGCACTCAGGCTGGGCA

TGGTGGCTCACGCCTGTAATCCTAGCACTTTGGGAGGCTGAGGGGAGTGGATCACTTGAGGT

TAGGAGTTTGAGACCAGCCTGGCCAATATGGTGAAACACCATCCCATCTCTACAAAAATACA

AAAAAGTTAGCCAGGGGTGGTGGCATCGCAGCTACTCAGGAGGCCGAGGCAGGAGAATTGC

TTGAACCTGGGAGGCAGAGGTTGCAGTGAGTCAAGATTGTGCCAGTACACTCCAGCCTGGG

CGACGAAGCAAGACTGTCTAAAAAAAAAAAAAAAAAAAAAAAATACGGGCACTCAATACAC

CGTATAATAATAATATAGTAATAATATTTGCTTAGGATCTTTAAAAAGTTTCATTTTTTCAGA

CTCCCACAGAAATGGCTCTGCACAGCAGAGTGAAGGGGGAGAGAGACTGAGTCTCCAGGCC

AGAAAAAGGCCAGGTTTTTTGCTTTTGTTTTTAGTTGTTGCCTGGATATTGCACAGAAAGAA

AAAATAATTAGCAAGTTAAACAAAAGTACCGCAAAGTTGATTACATTGGTATTTGAGTATCA

CATCTTCTCTCAGAAGCGTAAGAGACAAGGTCGTGACCATACCTCTGCTTAGTTTTGTTTTGT

AATGGTGTTGCTAGTGATCGGCTTGTCACCAGTTACTGGTGTTTCTAAATGGACTATAATTGG

CTACTTGAAAGGACTTCCTGAGAAAGAACATTTTGGAGGACGAGGAGAGAGTGCCTTCTCTA

TTTTGGCTGCTTTCATGTGACATGCAAGAGACCATGACGTTTAGGCTGCTGCTGAGGCAGCC

CCAGAAATGGGGGCCGAGAGGTCTTTTCTTCATTTTAATAGGGTCTGTAGGTTTGGGTGGTT

AGGTACAGTTCTCAGAATGGAGGTTCCTGGCTATGAGGCCTTGAGAAAGCTGAAAGTCTCCT

TGGGAGTGTGTGGGTGGGGGGAGTCGAGCCCATCTGTTCATGGGCAGGTGTCAGCCAAAGC

CCTTGCGGGTGGTTTTGAGGTTGGTGGGAGAAAGCATCCGTGGGGTTTAGAGTTGTGGCCTT

TTCACTACTTGCAGTTCCTTTCCCCGACTTGGCTTTACTTTCTGGTGTCCAGGGGTCTGGGCC

AGATGCTGAGATTCCTCTCAGCTGACAGGTGTGGGTTATGGGCAAACCCTTCCCTGGAGGAC

ATAAGGCACCGGATTGGACTGCTGATGGGTTGCTGTTGGAGTTGTCAGGGCCTTGGAATAGT

CTTCAGATAGACTTGGGTTAGTGTGACCTGGGGCAGGCTGCAGGTTTGGAGCCATAGTACCC

CCCGCCCCCACACCGGGCACCCTGCTCTGGGCTAATGTGAGGCTTGCAGGAGTGAGTGATGC

AGTGGGAAGGGGGGCCTTTCCTGAGGATTCTACAGCTTTCTCCAGGGAATCCTCCCAGGTAG

TTTAGGCCTGCAGGTGCTATGCTATCCTTCTTTCCTAACCCTGTCTCAGGTCCTCAGCGGGGC

CATGCGGCATCCACTTATAACCCTGCAGCGAGGCCCTCTTTTCTGGCCACCTGGGTGTTTGCC

TGCTGAGATGGGAGGAACAGTGGCCTTGGGCTTCTTCCCCCGTCATGTTTATCTCTGCTCAGA

TTGGGCAGCAGCTCAATGGGACTTGACCAGCTGTGGCACTGCCAGTCTGAAGATGAGTAGG

GTGATGGGGGGAGGTGGGCAGTACCTGAAGCTGAACTGGTGAGAGAGGCAGGCTGGCCTGG

GGGCTCAGCTGGGGCCTGGGATGGTTGGTACAGTCCCCTCAGGGGGGTAGGGGAGTGAGTG

TTAGACTGCTTAAGCCTCAGAGGCCGCTCTTGCCCACCTATGCTTTGAGGAGATCCTCTTCAT

TTGTTCAAAGGGAAGACTCTGATCTAGAGATGGGCACTTGGACCAGCAAACAGCAGCTACA

GGTAGCCAGGGCACCCGAGGAGCACTTGCTCATGAGCCGGTTTCCCTGGTTTTTATGGGGGC

TGTTGCTGAGCGTCTGCCAGGGTTTGTGTCCTAGCACTTGCTGGTCTTTGCTGGGCTCTCAGC

TCTCAGGTGTTTCTCTACCAGCACGTTTCCCCCTCCCTCATATGCACACATGTGGACACAAGC

AGGCTGCCCAGGACAGAGTGTACTTTGAGGCTTGGGAAAGGACTCTCTCTCGCCCTTTTGGG

GATGAGCCTTGGAACCTCATCACCTTCCGGCTTGGGGTGGAGCTTCATCCTGGGGGTTGAAG

CTTTAGGCTCAGATAACTAGTCTTGTAAGCCAGTTTTGTCCTGTTGTTTTTTTCGTGGAAAAT

-continued

AATGTATTGACGTATACACAGACATTCTTTGTCTAACAGTCTGAGATTGAGAAATACCCTCC

ATGACTATTTGGTTTGCTTTCATGGTGAAACTTGGTCGCTTTCTTAGACACAGCCTATGGCAA

TAAGAGTGATCCCTGGCTGCTGTAATTCATTCCAGACTTTGAGCAAACACAAGGCACCGCCT

CCACCTGCAGTGGAGCCTCTGATGAACCAAATGGAAACTCCTTGGGGAATGGGGAGTAAGA

GCCAAATGTGGGATTGGACTTAAACTGCAGCTTCTTAGAACTGTAGCATTCCACGATGGGAT

TGTCTAGTGCTCTTCCTGGAGGTTACTATTCAATAGTTGGCTAGTGCACAGGTTCAGGGGTG

ACCTGATATGCCCTAGCGTTTCAGAAGATCCCTGCAAGGTGTGTCTTTTGGTCCATCTGAAG

GGTCTTGTATGGTGATCTTGTATGGATATCCGTGACGGCTAAGGCATCTGATAACTTCATTCC

TTCAGTTCCAGCAGTGTTCCTGTATTATGCTGGGCACTAGAGCTACAAAGAAGAAAACAAAG

TGCCTCCTCTTCAGGAACTCTTAATTTAGGCAGGGGAGGCATAATTGAACAGTGCTGAGGTC

ATCTAGGGGAACCAAAGTGTGTATTTATCCCCTTCCCTATCACTCCCCTCCCTCCTTCATTTCT

TCCTTTCTTCTTTCAGAAACTCCAAGTTCATATCAAAATTCTCCAGCCCTGGTTTTATTTGGTT

GTGTGAAAATTTTCCTCTAATTTCTGAAGCTATGCATTAGTTCTGCTGAGTAATCTTTAACTT

GCTGCTTTATAATGATTATAATGAGATATCACTGGGTATTATGGTCTTTGGGTAGCAGCAGG

GTAGGGATTTCCAGGCTGGGACTAAGCTAATTTATGGGTTGGGAATTATGGGGCAGTTAATA

GCAAGGCAGTCCAAGCTTTCCACAGATTCCACCCTAGGGACCATCCAGACTTAAGGAACAG

GGCCGGCAGGCTCATCCCCTTTGCACTCAGCTGGGCTATGGGTGTGTGTTTGTGAAAGAGGT

TTATTCAGTAGTCATACCTGCTGATTTCCCTGCTATCTGTTTACCCAGTGCCTCCTGTACCTTG

TTTCTTACTCTTTGTTCTCTGCTCTTACTATGAAGAAGCAGAGACTGGAATTCTGCTTGAACC

CACATCTACCTGGAAATTCCAGTTTTTCTTGTCCAGTGGAGCAGCAATCCAGTTGTTTTAGGA

CAAATGGTCTGCCCTTGAAGCTTAAATCCTTTGAGGGCCTGGCATGGTGACAGTTTTACATTT

GGCTTTGGTATAGACTGGTGTGGTCCCTGGGCAGTGAGGTCACTGTAAGGCCAGCCAGCCAG

ACCCTGGCTCCTAGGGGAATTAACAAGGCATGGGATTAGACTCACAGGGTCCCTCCTGTCCC

TAAACTTGGTAGGGGTTCCTGGGAGCCAGACTGCGATTAAGATTGTAGAGACCTGAGACCTG

AGTTGTAGGGGCCTCTGTGTTGATCTGGGCCATTGCCGGGTGAGCTGAGGCGGTCACTAGCT

CAAGGAGTGATCTCAGGATATTGTTCTGTAAGTCAGAGACCTCCAGGTTGGAGAGTGGGGCT

TGGGGGTGGGGGACAGGGTTTAGTGGGGAGCTGGTTCTGGGTGAATGTGGCCTAAAGGGAT

TTGTCCTTAGAAGACAGAGGGGTGAGTCACACACTCAGTGCTTCAGGTTCCACTTTGCGGCT

TGGCCTCAGCCCGCCCCTTCCCTGCACAAATGAAGGCCAGGGGCTATATAATTGGCTGTTGC

TGAATTCTTTGGCAGTGATTTTAAAGTCTGGTCTGGGTGTGTTATGTAGCTGCTTCTCTATCC

ACTCCCCACACCCGCTGCTTCTCCAGAGCCCCTCACAAAGCCCAGGCAGAGAGAGAGAGAG

AGAGAGAGAGAATGACTTGCCTCACAGAGATGTTGGGGATAGGGATAGGGGTATGGGTCTT

TGCTTTTGCCTTTTGAGGGGGGATAATCTCTTCCTTCATTTTAAAAGTAAAAAGTAATGCAGG

CTCATTGAAAATAATTTGAAAAGTTGAAAGAGATATAAAAGCACACCCAAATTCCTATCACC

CAAAAGAAACATACCGGCATATTTCCTACTAGTCTTTTTCATGTTTAAGAATATAGCTGATAT

ATTTTTTTTTCTTTTTCTTTTTGAGACAGGGTTTTTGCTCTGTCACCCAGGCTGGAGTGCAGTG

ATCACGGCTCACTGCAGCCTCGACCTCTCGGGCTAAGCGATTCTCCCACTTCAGTCTCCCGA

GTTGCTGGGACCACAGGTGCACACCGCCATGCCTGACTAATTTTTGTATTTTTTGTAGAGATG

GGGTTTTGCCATGTTGCCTAGGCTGGTCTCGAACTCCAGAGCTCAAGTGATTCACCTGCCTTG

GCCTCCCAAAGCGCTGGGATTATAGGTGTCAGTCACCACACCCAGTGTTATAGCTGTTGTCT

-continued

TTATAGATGAACAGATAGATTGACATAGATTCATGTAGATAGCCTGGTGTTCAGCATTTTTC

ATTTAAGATTCTGTCACAGACTTGACCCTATACCTTTAAAAATCACAAAGGCAGTATCATAG

TCTGTCAGCTGAATATGCCATAACTTAAAAAAATCATTCAACTGTTGCTGAACACACACATA

TACATATATAGTTTTTGTTTTTTCTTAGTGATGTAGTGATGCTTGTGCAGAAAGCTTTATGTA

CTTTTTGGATGGTTTCTGTAGGAGAGCTTTCTAAAAAAGGAAAAAAAGTGTTGAATGTTTTTT

GAGAAGGGCTAGATTTTCAAGCCAGTCTTACAAAAGGATAGACTCATTGGAAATTCCAGATT

TGCTTAGTGCTGGCAGATGAGTATCACTTATTGCTGAACAATGTGTCTAGAATTCTGATTAA

AAAAGAAACTAGGTCCAGGAAGTGCCTGGGGGCAGGGGCAAAGGGCCAGGCTGCAGGATA

GGCTCTTAGGATCTGGCTGAGCAGAAATCTGCTGTGAACAGAATCGGTGGGGGTGATGCTTT

CTCAGTAACTTCTCCATTTGTTTCTTTAGCAGCTAAGTCCCTGTGCTGGACTTCTGTGGACTA

CTGTGGCTCTGGGGCTGTGGTTGTGGGTGAACAACAGCTAGCTAAACCAGTGCTGTTGACAT

CATTGAGATGTGACGCACAGGAAGGTGGGAGCAAGCTTGCAAATCAGATTCTGAAACATAT

AGCACAGCTCTCCCACCTCCAGGTGGTCCTGAGATCTAGGGAGGAGCCATAGTGAGAAACTT

TAGGTTTCTAGGAATTCTCTTAGGGAGAAGCTCTCTTAGGGAGAGGCAGAACCTGGTTCTCA

GTTGGGGCTGATTCAGGTGGGTTAGATCAATAAAGCCTCAGGCCAGTGTGCCAGGCTATTCC

CAAGGAGTATACTTTGAAGTTACTCCCTTTAGAATGTCCTCAGTGGAGATAAATTCTCTCTGA

GGAGCAGTTTTGTCTGCCGGGGTCATTTGGCACAAAGCCTGGAGTGCTAGGGCGAGGTTGCA

CTGAGGGAAGGGGCAGGATTATGTCAGCAGTGTGACGGATACAGTGTGAGGTCAGGCTCCT

TCCTGCCCCACCACGGGGGCCTAGAGGTCATGGGGAGGGTCCCTGGCAGGGGATTCAATCA

TTGCTTGGCCCCATGACAGAGTATATTCTAAAAATGCCTTAAGTTTTTTTCTTTCAAAGTTTC

TTCCTGTTTTGCATAATGGCCTTTTGCCTTTGACATCCTGAAACCGCAGAGCTGTCATTGGTG

TTGCAGGACACTGCCAGCTTGAAAAAAATCAACAACAAAAAAAGAAACAGGAAAGGATGT

GGAGTTCAGGGTGCGGCCTAGGGAAGCTGGTATTTGCGTTATGGGATTGTGGGGATGTGGTA

TTAAGGTGTTGGGTAGCGCCTGACATTTAGAGGAGTACTCTGGGCAGAGTCCCTGCCTGCCC

AAGAATAGGTAGAATTGAGTCTTCACACCAAAGTCAGGAGAGACCCCCTCCCCCCAGGAAG

AGAATGAACAGGGACTCATTTCCTCATTCAGCAAACTTTTATTGGTAACTACACTATATGAA

GTGTGAGAGATAGACATGAACAAGAGAGGCCCCCACTCTTGGGCAGTCCCTTAGTAGTAGT

AGATAGACTCTGGCAATATGGTGTGGTCAGAGAGAGGAAGCCTGGGTGCTTTGAGGGTACT

GAGGAGGTGCAGGGAGCCAAATGGGTGGTCTGGGCCAGGGCCAGAGTCAGAATGAAGGAC

CTCTCTTCCAGACGTTGATTTTAGCATCTCTGTCTCTCAGTATGTTTGAACAGTCTCCCTTATT

GGAAGGGCAGGAGTCTACTGCTAAAAGTAACCTGCGATTTCCTCTACTTGCTGTCATGTGGA

AAGAATACTAAAGCTGAAATTCCAAAAGTTGCACACCTTTACCAGCAGGGCAGGAGAGGAA

AGGAAATGGAGGCAGAGTGAGCTGAAGATGATAAAAGAAAGAGAAGGTGGTGCAGTTTGG

ACTGTTATGGACAGAGGAAGTCTGAGGGTAGCTGGACTGAGGGATCAAAGGGAGGCAGTTG

AAAGGGAAGAGAGCTGCAGAGAGGGATTTCTTGGTCTGCAGAGGGTAGGAGCAAGCCTTGA

AGGCTGCTGGAGTGAGGATTCCGAGCCCTGGTCTTTATTCTTTTTCTAATTCATTACATCATT

TTAGGCAAGTCCTAACTCCTTTGGTCTCTGTTGTCTTTCTGAAATTTGAGTGGGCTGGGCCTG

CTGGTCTTTAGCCTCTGTCTTTCTCTACCTCCTAGATTCCAGTTTGGCGAGTGGGGGGGAAAA

CCTGGTTGTATATGCAACGTGAAAGGCCTCTGGAATTCCTTTTGAAGCTCACTACCCATGAG

GCTTCTGCTAAGGATTTCATCATGTCTGTCTAAGCAGACATAAAAATTTTAGCAGGTGGATG

ACCCGTAGAAATGGCACAAGGAATGTTTCTTTCTGTCACACTGTGGTATTTGATTTAAGAAA

-continued

GTTGTTATCCTCTCTGTGCCTCAGTGTTCTCACTTGTAAAATGGCAATAACAGTATCCACCTC

ATAGATGTTATGAAATACAGGTAGTAGCCACGAAAGGGCTTAAAACAGTGCCTAACACAGA

ATAAGTTGTGAATATATGTTATTTATTATTGGTAGTATAATGCTTATTTGTGAAGATTTTGGC

TTTTGCTTTATAGGACCTTTTTTTTTTTTAGTTGAAAATACAATGTTACCATGTTAAATGTTAA

AAAAAATTCTACTTACCATTGTAACAGAACATGCTCCCACTTCTGTAACAGAGCTTGCTATT

ACTTTTCAAATGCATACATATTCCAATGCATATATTCCAATGCAGTTGTAGAGTGAAACTGTT

TGCATGCAGCCATTTTTATCCAACATTATCTTATAAAATGTTATGTTGTTTATGATTATCCTA

ATTATCTTTTGTTGCTGTCTAGTATCCTTATAGATATTCCATTAGCATACACTATTCCAGGTTT

CACTATCGTCGATAATCTAGATATGAACATTTTTGTAGTGTGTAGCTCTTTGCTTCAGTTGAA

TTACTTTCCTGGGATAAATTCCTGGGGAAGAATTTCTAGGCCAGAGGATATGGTCATCTTGA

CAATACTGATTCACATTGCTGCATTGCTTTCCAAGAGGTTTGGAATCATTCACAGGTTCTAAA

TTGGAAAATCCTGGCTTTTGAAGTATGTGGATTCTAAGGGCGATTTGGATCTAGCTGGAGCC

TCACACTGACACTTCCAGCCAGTGTGTGTGTGTGTGTGTGTGTGTGTGTGTGTGTGTGTAGTT

CCCTATGCTGGACACCGTGTGTGTGTGTGTGTGTGTGTGTGTGTGTGTGTGTGTAGTTCCCTA

TGCTGGACACCATGTGGCCTTTCTGGACATTAGGGTTTTCCTGTGATTGCCTCAGAGCAGTTC

CTGTTGAATTCACTCTGTGTCCACAAAAGGAGCCTTACTGTGGCTCTTTCAACACCCACCTAC

CTTTGCCAAGTTGGTTTACAGAAAGTAAGAACATTCTTTCCTTCTTCCTTGATATGTGGCGCT

AAACCTATAGCATGGGGCAGGCTCTGGCTTTAAAAACCTGACTTAAAAATAATGGTGTTGAT

CAAAAAGTTTGTGGATCAGTTTTTGGAAACACTGCATGTAGCCATCCATAGAAACTTATATT

CTGTTGGGCTAGCCTGGGCGCCTGATCATTTAACTCATGTGGATGAACTTCTATGTAATAGCC

CTGGTGTATGGGATCCAGAAACAGGGCCCTAATGAAGAAAGGCTTTTAAATTATGTTGGATA

AAAATAAGTTGTTACAATAGCCCAAAGTCTGCAAATATGAATTGCCAGTTCTGTCCTTGTAG

TCATCCACCATGTGCCTGCATCTTTTGTAGACTCTTGTAGATTCAGAAGCCCACTGAATTGCA

TAAATGATGGAATGATTTTAGACTTAGTGATTTCAGTGACTAAAAGTTTACAGATCCTGGCC

GGGCACAGTGGCTCACACCCGTATTCCCAGCACTTTGGGAGGCCGAGGTGGGTGGATCACCT

GAGGTCAGGAGTTTGAGACCAGCCTGGCCAACATGGTGAAACCTTGTCTCTACTAAAAATAC

AAAAATTAGCCGGGTGTGGTGGCATGCACCTGTTGTCCCAGCTACTTGGGAGGCTGAGGTGG

GAGAATGGCTTGAACCTGGGAGGCGGAGGTTGCAGTGAGCCCACATCAGGCCACTGCACTC

CAGCCTGGGTGACAGAGTGAGACTCTGTCTCCACCTCCCCCGCCCCCCGAAAAAAAAAAAA

GTTTACAGATCCAGCAGATGGGGCATATTCAATTTGTGACAGCCACTCCCTTCACCTTATAG

CTATGTCATATGTCTTCTTCTCCTTTGACTGCATTCTGCAGCAGTCAGTTGTGACTTAATATG

GCACTCTGGGCCCACTGAATTAGGTCAGAGCTGCTAGTAGTATATTGTTCCTAGAGACCTAG

GGCAAGATTTTCTTACTACATAAAATGAGGGAGATAATTTCTTACCTCAAGATGTTGGTAAG

AGGAGTGAATGAGGTTAGTTATATGGTAATATCAGTACTCTGAATGTCTTTTGATCAATGCC

TAACTCATCTTCTTGGGCACAAAAGGCATACAGTCAGCACCCTTAGGCCACATATAAAATTC

CTCCAAATGCAGGTTTTCATCTGCCTTGGGGCAGAGTCAAGAGAAAGAAGAGGAAGAGGCG

TGAGGCTCTGACCACAACTTAGGGACAGAATATAGCCCAAAGCGAGTACCCCAGGCCACAA

GGAGAAGGCCGCTATCTTGTTGAATCCACAGCACTGGAAACTTGGAGTGTGTGTTCCCCTGT

GTCAGTTACACTGGAATTTTATGGCTGCTCACATTCTTCCCTTCAGGTGGACGTTGTTCATCA

GTATCCTGGGCAAGAGGCCATCATAAACCACAGACAGCTGAGTGATTAGGAAGAGGAGCTG

-continued

AAGAGGGAGCATTAGATGTTTGATTGAGTCTTAGGTGAGAAAGTATATCATTAAAACAAAA

AGATAGATGTAGGCGGGCTCAGTCTTGTGTGCCTGGTGTGTTGGTAGAAAAACTAAAGCACA

AGCCTGTAGATAACCTGCTTTATTCTACCTCGGGGCTGGTGTTGGAATCCAGGATGCCAGAC

CCTAAAGTCCAGCTCTCTTTCCAACCTACTGAATAATCCGAGAGAAATCATGTTCTCTCTCTG

GGCCTCAGTTTGCCCATGTATAAAATGAGATGAAGGATTGGCTGGGATGCTCTCCAGAGTCT

CTTCCTGCCTGGAGTTCTGACGTAGCCATGTACTCCTGCTCAGCATCGCTAAATGGCTTTGTG

GTAGGACCATTGAGTGCTGCCTCCATTAGGGCCAGCTATGTAATGCTGGGGTGGCTGTCACT

GGGCCCTAAGAGCCAGGATTGGTCTTACTGGAGAAATCCACATCCACCTAAACTTAAGACCC

AGGGGTGTCCAATCTTTTGGCTTCCCCAGGCCACACTGGAAGAAGAATTGTCTTGGACCGCA

TATAAAATACACTAATTATAGCCGATGAGGTTAAAAAAAAAAAACTCAATATTTTAAGAGA

GTTCATGAATTTGTGTTGAGCTGCATTCAAAGCCATCCTGGCCGCATGTGGCCCATGGGCCA

TCGGTTGGACATGCTTGCTTTAGACCTCCCAGCAATTCTAGTCTCTAAACAGGAAATCAAAA

GTCAAGATGAATAGATAAGTTGGTCAGTGTGAAAAAGTAATTGGTGGGAGCCACTGTAGAT

GCAGGGTTCTAGGCTCCATCAACAACCACCTACATCACTGAACGAAAGATAATGCTTGTTCA

GCACTTATTACATGCCAACCATGGTAAAAATACTTCAGATGCATTGTTTTCATGAACTCTCAC

AGCAGCTCTTTTTCTTGCCTAAATGCCCCGTTAGAACCTCCAGTACAATGTTAAATAGATATG

CTAAGAGACAACATATGTGTCTTGTTAGGGGGAAAATATCCAGTCTTTGACTATTAAGAATG

GTGTTAGCAGTGGGTTTTTCCTAGGTGCCCTTTATCAGGTTGAGGAAGTTCCTTTCTATTCCT

GGTTTGTTGAGTATTTTTATCATGAAAAGGTGATGGGTTTTGTCAAATGCTTTTCTGTGTCTG

TTGAGATGATCATGTTTTTTTGTCATTTATTCTATTGATATGGTATATTATACATTGATTTTTC

AGATATTAATCTTGCATACCTGGGATAAATCCCACTTGGTCATGGTGTATAATTCTTTTTATT

TGTTGCTGGATTGAGTTTGCTAGTATTTTGTTGATTTGTATTCATAACAGATAGTGGTCTGTA

GTCTTTCCCTCCCTCCCTCCCTCCCTCCCTCCCTCCCTCCCTTCCTTCCTTCCTCTCTCTCTCTCTC

TCCCCTCCCCTCCCTTCTTTTCCCCTCCTCTCCCCTCCCCTTCCCTTTCTTCTCTTTCATAGTTG

TTTACCACTGTCAGAAAAGGTCTGTTCGTTTTCTTTCGTCGTGAGATCTTTGTTTGGTTTTGGT

ATCAGGGTAATACTGCCTCAAAAAATGAGTAGGGAAGTGTTCCTTCCTCTTCTGTATTTTGA

GAGAGTTTGTGGTCGGTTTTTATTAATTCTTCTTTAAATATCTGGTAGCGTTCACCAGTAAAG

CCATCTGGGCCTGATGTTTTCTTTGTGGAAAACTTTTTGATTCCTAATTCAGTTTCTGGTTATA

GGTCTATTCAGACCTTCTATTTTTTCTTAAGTCAGTTTTGATAGTTTGTGTCTTCCAAGGAGTT

TGCTTCATCTAAGTCATCTAATTTGTTGGCATACATTTCATAGTGATTCCTTATGATCCTTTTT

ATTTCCGTTAAAGTTGGTGTAGGGATAGTCCCTCTTTCATTACTGATTATAATAATTTGAATT

TTCTTTTTTTCTTAGTCTTGCCAAAAGCTTGTCATTTTTATTGATCTTTTCAGAGGACCAACTT

TGAGTTCATTATTTGTTCTCTTTGTTCTTATTTTTCTGCTTCATTAACTTCTCTAATCTTTATTC

TTTCATTCTGCTTGCTTTTGGTTAAGTTTGCTTTTTCTGGTGTCTTAAGGTAGAAGGTTAGGTT

ACTGATTTGAGATTTAAAGATCATGCTCTTTAAACGTTTTGATAGATACTGTCAGTTTGCCCT

CTGGCTTTTTCTCATTAACAGTGTATAGGAGTGCTTATTCCTCACACTCATACCAGCCCTGGG

TGTTACTAACCTTTATATATTTGCCAGTATCATATTCAGACATAGTATCTTGTTTTAATATGTT

TCTCTGATTACTGATGAAGTTAAGCAAATTTTCACGTGTTTATTGGCCATCTGTCTTTCTTTTT

TCATCCTTTCTTTCAAGATGGGAGTCTTTGCCATGTTGCCCAGGCTGGACTCGAACTCCTGGG

CTCAAATGATCTTCCTGCCTCAGCCTCCTGAGTAGCTGGGACTATAGGCGTGAGCCACCATG

GCTGGCTTGCCCATTTGTATTTCTTATGTGAGTATTTTTTCTTTTTTTTTGAAGTGGAGTCTCA

-continued

CTCCATCCCCCAGAGTGGAGTGCAGTTGTCCGATCTTGGCTCACTGCAACCACCGCCTCCCA

GGTTCAAGTGATTCTCACACCTTAGCCTCCCAAGTATCTGGGACTATAGGTGTGTGCCACCA

CACCTGGCTAATATTTGTATTTTTAGCAGAGATGGGGTTTCACCATGTTGGCCAGGCTGGTTT

CAAACTGGCCTCAAGTGATTCACCTGCCTCGGCCTCCCAAAGTGCTGGGATTACAGGTGTGA

GCCACTGTGCCCAGCTGACTTTTTTTTTCTTTTTTTTAACCCTTTTTTTTTTTACCCTTTTTTTG

GCCCATTTTTTTTTACCCTTTTTCTTTTAACCCATTTTTCTATTAGTTTTAAAAATATGTTTGCA

GGAGCTTTTTATATTGTGGATTTTTCTTGTTTATTACATATCATTTGTAAATATGGTCTCTCCA

TCTGTCACTCTTCTTTATCTCTGGTTTCTTTAGCTATGTAGAAGTTGTTATGTTATGTTATGTT

ATGTTATGTTATGTTATGTTATGTTATGTTATGTTATGTTATTTTTTGGAGAGGGAGTCTTGCT

CTGTCGCCCAGGCTGGAGTGCAGTGGTGAAATCTCGGCTCACTGCAACCTCTGCCTCCTGGG

TTCAAGCGATTCTCCTGCCTCAGCTTCCCGAGAAGCTGTGATTACAGGCACCCGCCACCACA

CCCAGCTAATTTTTGTGTTTTAGTAGAGACGGGGTTTCACTATGTAGGTCAAGCTGATCTCAA

ACTCCTGATCTCAAATGATCCTCCCAAAGTGCTGGGGTTACAGGCGTGAGCCACTGCACTCG

GCCAGAAGTTTTGAATTTTTATGTGTTTAAATCTATGTTTTCCTTTATGACTTCAGGTTGCTTT

CATACTTAAGCAGGTCTTCACCATCCCAAAATGATAAAATTTTTCTCCTGAGTTTTCTTCTAA

GTTGGTTCTTTAGAAGCCACCAACTTGGCTTCGACAGCAAAAGATGAACAGAATTTCTGTTC

AACTCTCATGCTGCAAGAAGCTTTATGTAATACTCCAGGGACCCTTTAAGGTCCCAGAGTTT

TCCTCCAAATCTATCAGTGATTCTAGTGGCTAAGAGTAGAAATGTGAAAATTTAGCCATGTG

TGCTGATAGAGCTGTAGTAATTTGTAAGCTCTGAAGTTCTAAGGAGTCAGGGGAGAAGGGA

AAGTAACATTTATTGAACATCTATTAGCTCAATAAGAACATGCGATAAGTATGTATATGTAT

TATTTCACTTACATCTGAAAGGAAGGCATAATTATCCCCACTCCTTAGAGAAGGAAATTGGA

GCTGGCTACATTTAAAGTAGTCCTGACACCAGAGAGATATTGCCAGGAGTACTTGGCTGGCT

GAGTGCCCAGATGGCCCATAGGAGTAGTGGGCCCTCCACAGTCCAAGGTCTGGTTCTAGGTG

GAGAGAGAAGGATGTGCTCGTAGTCAGCACCGCAGCTCCAGAAAATCTGCTGGGGCTCCAA

AACTGATTAGAGGGGCAGCTGACTCAGTAATAAAACTCCCAGGAGACTTACTTACATACTGG

AATGCAAAGTTGCAGCTTTACTGGGAAGATTAGAACTGTTATTGAGTAGCTTAGAAATCTCT

GGCTGAATTCACTGCAAGGGAAGCCGCAGGATAAGCTAACTGCTGGTGAGTCAGCAGTCAG

AGCAGGGAAGTGAATTTAACATTAGATGGGTCAGTCTCTCGTGGCTGATGAATTCATCCCCA

CAATACTGTACACCTGCCTTAGGGACCTTTGTCTGGACTAGGGGTTGGGGTCCCCCTCCTTTG

TACAGCCCTGGAAGGACACATCCAGCTCCATCCGCCATCTCTCCCTTACTTATTTCCTTCCTT

CCTTCCTTCTTTCCATCCAGCCATCAAGCTTCCTTTCATGGCCAATAATCATCATTGGGGTCT

ACTCATGGACTCTCTTGCCTCATGTATTTGTTTTATTTTGTCCTCATTCCCACTTCTATTTCCC

AGGTATATCACAGGCAACTATTCTAACGTATTTATAGTTTGTGTATCTGTTTTTGCTCTTGCC

AAAATGGAAGCCACTGCTTTATACATAGATGTATTCTTAACTTTAAAAAAAATTTTTTTAGAT

TAACCTACAATAAAATTGGCTTTTTGGCATATAGTCTATAAATTTTAACACATACATATTTTT

GTGTATCTACCACCACAATCAGGATACAGAACAGTTCCATCACCCCAAAAAAATCCCTCTTG

TAGTCACATTCTCCTCCCACCCTTAATCCCAGGCAACCACTGATCTATTCTTCATTACTATTG

TTTTGTCTTTTTGAGGATGTCACATAAATGGAGTCACACAGTATATATACATTTTTTTAAACA

TATGTAAATGGCATTTTATAGCTCATTTTGATTATATGTTTTTCATCCAGTTCTGTTTTTTTTTT

TTATTTTTAAAAAGTTTGACATAACTTCAGACTTACAGAAAAGTTGTTAGACTAATACAAAG

-continued

AATTCCTGGATATCCTTTGGAGTCCCTAAATGTTAACATTTTACTATATTTACTTTTTCCTTCT

CTCTCTCTCTCTCTCTCGCTCTGTGTGTGTGTGTGTGTGTGTGTGTGTGTGTATCTACCTGT

AGATAGATAGATATTAATATAATTTTAGATAGATGTATCTAGATCTCTCTCTCTCATATATAT

GTGTGTGTGTATATATCTATATCTATATCTATATATATCTCCTTTTACCCTTAAATATTCAGTG

TATATTTCCTAACAACAAGGTGATTTAAAAATATATATATAAACATAGTATAATTAACAATC

AGGACATCAACATTGAAACATTTCTGCTATGTCATCTACAGGCCTTAGGAAGACTTTGTCAG

GTGCCCCAATAATAGCCTTGATGGTAGAAGAAAACCATGTGTTGTATTCAGTTGTCATGTCT

CTTAGTGTCTTGTAATCTGAAATAATTCCCAAGCCCTTTGGATTTCATGACAGTGACATTGTT

GAAGAGTACAGGCCAGTTATTTTGTAGAAGGTCTCTCAGTTTAGGTCTGTCTGATGTTTCCTC

CTGATCAGATTCAGGTTATTCACTTTTGACAGGAATACCACTGAAATGATGCTGAGTTCTTCT

CAGTGTAACGAGATCTAGAGACACACACTGTCAGTTTGTTCCTTATTGGCAGTGTGAACCTT

GAGGATTTCATTGTAGTGGCATTTGGCATTACTCCATTATAGTTACTATTTTACCATTTTAAA

TTAAAACTATCTGGCCGGGCGTAGTAGCTCATGTCTGTAATCCCAGCACTTTAGGAGGCTGA

GGCGGGCAAATTGCTTGAGGTCAGAAGTTTGAAACCATCCTAGCCAACATAACATGGTGAA

ACGCCATCTCTATAAAAAATACAAAAAATTAGCCTGGCGTGGTGGCGCATTTGTAGTTCCAG

CTACTCAGGAGGCTGAGGCACAAGGCTTGCTTGAGCCTGGGAGGCGGAGGTTGCAGTGAGC

TGAAATCACGCCACTGCACTCTAGCCAGGGTGACAGAGTGAGACTCTGTCTCAAAAAAAAA

AAGTAAATAAATAAAAAAATTTTTTAAGTATCTTATGGGCATATACTTGTCCTGTTACTCCTC

AAACTTTCATCCACTTTTTTTTTTTTAAATTTTTTTTCTTACCTTTCATCGTTTTCTTGATATCC

ACTGGGTTTTAGCATCTACAAATGATTCTTGCCTGAATCAGTTATTATGGTAGTTGATGGTTT

TCTAATTCCATTATTCCTTCTATGTTTGTTAATTTTGGCATTCTTCTATAAGGAAGAGCTTACC

CTTTTTCCCTATTAATTAATTCATATATTAATGCAGACCTATGCATTCTTACTTCATTAAATCA

TAATCCTTTACTATCATTATGTATTCTGATGTTCAGACTATCCCAGATTTAGCCAATAAGATC

CCCTTCAGGGGAATGGTCTTTGGGATTCCTCTTTAGAGGTTCCTGGTTCCTGTTTTCTTTTGAC

ATATCCTATTACTCTTTGAGCATTTTTTTTTTTTTTTTTACTTTTAGGCACAGCAAGAAGTTCC

ATGGTCCTCTTGTTCTTTCCCCAACTCAGCCCTAGAGTCAGTCACTTCTCCAATGAGCTCTAG

TTCCTTTTAGTAGAGAATCATAATTAGAAAACAAGAATCAGTGCCAAGTGTGCACCTTTGTT

TTTAAGGTCCATCCACGTTGCCGTGTATATGTCCAGCATGTTGATTCTAACTGCTGAATAATA

CCTCATGATTGTCATCCATCCCAGTGTTTCTTTTTCCCTTCTGTAATGAGGGACTCCTGGACT

GCCTCCAGCATTACCTTCACAAATATTGCTGTGAGGAAAATCCTTAAACGTTTCCTTTATGGG

CAACGTGTGAGCATGTTTATGTTGATTCAGGGGTGCCAGACACAGCTCCAGAATGGCTGCCT

CAGTTTACATTTCCACCAGCAGAGCATGACAGGCTCTGTGTCTCCGTGAATAATCAGCATTA

ACCAGCTTCCTATTTTTTGCCAAACTAATAGATGTGCTAGGATAACTCTTTGTTTTAACTTGT

TTTTCTCTGATTACCAATGAGCTGGAGCATTTCTTCATATGCCTGATGGTCTTTGGGATTCCT

CTTAGGTAAATTGCTTATTCATTATAATCCTTTGCCTGTTTTTCACTGGAGTTCTTATATTTTT

CTTGAAGATATGCAGGAATTCCTTATACATCCTAGATATTAATCCCTTCCTGGTCTCAGACAT

TGCAGATATCTTCTGAATCTGTTATTTACTTATTTATTTACAATTTTTTTTTTAAGAGTTGGGG

TTTTGCTCTGTCACCCAGACTGGAGTGCAGTGGTATGATCATGACTCATTGTGGCCTCGCAAT

CCTGGGCTTAAGCGATCCTCCCACCTCAGCCTCCTGAGTAGTTGGGACTACAGGTATGCACC

ACCAGACTTGGCTAATTTTATTTTATTTTTTAGAGATGGAAGTCTTAATATGTTGCTCAGGCC

AATCTTGAACTCCTGGCCTCAAGCAATCTTTCCACCTCAGCCTCCTGCATCTATTATATATAT

-continued

GTTCACTTTGCTCATGCTGTATTTTGTTGCAACATAAAACTATTTTTCCCATTGTTTTGTGCAG

TCTCTCACCAGCACTCTTCTTTTTCTGTAACTGTGTTAATGCCCTTTGTTCTTCCATATGTTAG

GTATGCTGGTATAGTTGAACTCTGCTGACTCTCCTCAGTAAACAGTCTCTTTTTATGACACCT

TATCCTCTACTGAATTCTCTCTATCAAGAATGACTTGGCCGGGCATGGGGGCTCATGCCTGTA

ATCCCAGCATTCTGGGAGGCCGAGGTGGGCAGATCACCCGAGGTCAGAAGTTCAAGACCAG

CCCGGCCAACACGGTGAAACCCTGTCTCTATGAAAATACAAAAATCAGCTGGGCGTGGTGG

CAGGTGCCTGTAATCCCAGCTACTTGGGAGGCTGAGGCGGGAGAATCACTTGAACCTGAGG

GGGAGGTTGCAGTAAGCCGGGATGGCACATTGCACTCCAGACTGGGTGATGGAGAAACTCC

ATCTCAGGGGGAAAAAAAAAAAAAAAAAAAAGAATGACTTGTCTTCCTCTTAGAGTGTGAGG

TCTACATACAAATATTATTCTTGTATTCAGCAAATGTATGTCATAGGCCTAGTGTGTGTTAGG

AACTGTGCTGTCACCAACAAAGTTTAGAGAGGTTATAAAACTTGACTGTAGCTTTTTAGAGG

TGGAGGAGTGATTTGAAACCTAGGCTGTAATTCCTTCCTCCTGTGATTCCTTCCTACTGTGTT

GCCTTCCCTTGAAAATTGCATTTGGGGGCCAGGTGTGGTGGCTCTCGCCTGTAATCCCAGCA

CTTTGGGAGGCTGAGGCGGGTGGATCACCTGAGGTCAGGAGTTCAAGACCAGCCTGGCCAA

CATGGCGAAACCCCGTCTTTACTAAAAATACAAAAATTAGCTGGATGTGGTGTGTGGTGACA

TGCACCTATATTCCCAGGTACTCAGTAGGCTGAGGCAAGAGAATCACTTGAACCCAGGAGG

CAGAGGCTGCAGTGAGCTGAAATTGCACCACTGCACTCCAGCCTGAGTGACAGAGTGAGAC

TCTGTCTCAAAAAAAAAAAAAAGAAAAGAAAGAAAATTGCATTTAGTTCCTGTAGACTGTG

TGTCAAATGTCTAAATCTCTTCTAACAAATGGCCTAAGGAGGTGCAAAGCGAAGCATCCTCA

CCAGCATCCTGACTTGGCAGTGAGGCATGGGACCCTGGAGGGAGTAGTGGTAAGTGTGACT

CTGGAATTCTTCCTGGGCTACTTGTCAGTGACTGGCTCCAGATTGAGAGGAGAGCCCAGAGG

ACACAGGTGGCTGCCCCAGCCTGGAGGTGAAAGTCTTAAAATAAAATGCCAGATGCCTAGA

CCATTCTAAACCTTTCTGAGAAGCTGAAATCATCCCTTCTGGAAGCGCTCTAGTTCTAAAAG

GACAGATATACAGCAAGATCTTCCTGGGGCTAATATGGAGTTTATAGGCAAGTAGGCCTCAG

AACCTTTCCCTGGTAGTGATATCTGTGGGCAGGCACAGTTTCCACACTTTCCAGAAATTCCA

GCGGAAGGAGTGAGAAGGAGGAATCTGCCCTTGAGTGAGGACCAAAGAAAGCAGAAATTC

CTCTTGGGAATTTTTCCTCCAGAGACCAAACACTACTTGGGAGCTTGTTTACTGGGCTTTAAA

AGCTTGTGACCCCCAGTCACTCTTTCTTGACCCCAAGGCTTTGCATTTCTGTGGCTTCCCCAC

TGGACAGAAGTGGAACTGTCATGCTGCCTGTTCTGGGGTCTCCCAGAGGTTTCCCCATGTCC

TCTCCTTGCTTCTACTGCCCCACAGAATTGGGGATCTGTGACCACATATGGTATAGAATTAAT

GCTTGAGAATGGTTTAGTTCAGTGATGTCAAATAAGATTCACTTTTATGCCACCTCCATCAGT

TGAAGGCCCCCCTGGCCCCTAAATTGGAAAAGATTCTGAGACAGAATCCCCGTGGGTACAG

CGCAGGGACAGTAAAGGCACGTGTGCTGTGATTTGCTATCCACTGTGTGGATGCATCCAGGA

ATATCAGAACCCTGGAAGATTATTTAAGGGGAAGTTAGGACAGCTTTTTTGCCAATCCAAGG

GTGTTCTTGAGGAAGTCTGTCTTCCTGTATGGCCTTCAGTTTCTTTCCTGTGTAACCATGGGG

CCAACACATAATTCCCACAGCTCTATTGGCCCTTGTCTGCCAGGATTCTCTAGGGTCTGATTC

GAGGTGGATCCTGGCCCTTTGAGGTGGCAGAATCTGATCATGGTGCTGTTTCCTTAGATTTA

GGCCTTGATACCCTTGGCGAGAGCATCCTGGGCTGAGTGACCACCTGAGGTTTTTCTGGTGA

TTTTGTGACCCATGTAAAACTTTGAGCTTTGGGATTATTCTCTCAAGGAAATAGTGACATTTG

GTGAAGAGCCTGTTTGGTGTGGCTATGTGAGGCTTAGCCAAGAAAATGCACCATTTTTATTA

-continued

GGAGGTTAGGCCATCCGTTGCCACAAAGTGTCAGATGCTAGGCCTAGAGCCTGGAGAAAAC

TTATTTTAAAATTGATGGGGTGCTGGAGGGGTTGGGGGGTGGTGGCTGTAGCTCATGAATCA

GGTGCTAAACCTAGAAACAAAAGGCCTCATGTGGCAGACTGTTTCTGAGCACAGATGAATG

GATGAGCAACTGGCGCAACTTTGCCCAGTTGGTCCAGCTTCCCACTTGGCCACCTAGGCTTG

CTGTGAAGACCTCGTCTGGCAGAAATGAGAGTGTTTTTGCCCCATCTTGATCTTAACTGTAAT

TTAAGACTAAAATCTTAGATTCTAAAACATCAAAGGCAAGATGGCTCCCAGCTCTGTGAGCT

CAGCTTCTCACCTCTTAGTTGAACAAGTGCAGTGTGGGTCAATACATGATTGCTGCTCTTGCT

GCCAGGAACTGTCCCAGCATAGAAAGGAATGGGACACAATCCCTGCCGTCAAGATTCTAAG

GGAGGAAGCAGGCAGGTCGACTGGTGCCTCATCTCTGCAGGGCTCCAGCCAAGGTTTGTGA

AGGATTTTGCAGGCATATGGAGTGGGGACTGATTGATCCCGAGAGGGGACTGGGGAAAGCT

CTGAAGAGGGGATGACATTTGGTTTGAACTCCAAAAAATGGTTGCTTTACCTGTTTCCTGAA

GTTTTTGAGGTGGCTTATAAGAACATATACCATAAAAAGGACCAATATAAATTTAAAATCAG

AAAAAGAGAAAATGGGCTGGGCATGGTGGCTCATGCCTGTAATCCCAGCACTTTGGGAGGC

CAAGGTGGGTGGATCGTGAGGTCAGGAGATCGAGACCATCCTGCCTGGCCAACATGGTGAA

ACCCCGGCTCTACTAAAAATACAAAAAATTAGCTGGGTGTGGTGGCACATGCCTGTAGTCCC

ACCTACTTGGGAGGCTGAGGCAGGAGAATCGCTTGAAACCTGGGAGGCGGAGGTTGCAGTG

AGCTGAGATCGCACCACTGCACTCCAGCCTGGGCGACAGAGTGAGACTCCTCCTCAAAAAT

AAATAAATAAAGAGAAAATGGAACTTAGAAAATTAAGAGGAAGAGTGAAAAGGTAGATAT

TTAGTCAGGCACAGTGGCTCATGCCTGTAATCCCAACACTTTGGGAGGCCAAGACAGGAAA

ATCTCTTGAGACCAGGAGCTTGAGACTTGCCTGGCAACATCTCAGGTGAGACCTTATCTCTA

CAAAAAATTTAAAAATTAGCTGAGCTGTGTGGCTCGTGACTGTGATCCCAGCTACTCAGGAG

GCCGAGACCACAGCCCAGGAGGATCGCTTGGGCCCAGCAGTTTGAGGCTGCAGTGAGCTGG

CACCACTGCAATTCAGCCTGGGCTACAGAGCAAGACCCAGTTTAAAAAAAAAAAAAAAGAT

ATTCAAACCATGGGTCCCAACGTAGTTATTATATTTGACCATTTGCAAAAGCTGAAAGCAAA

ACATGTTACACATTTTCAGAGAGGAAAATACACAGTAGTTCCTGAGTGTAAGTTGTTTTTCTT

GACCTCATTCTTAAATTGCTTCATGAGGGTGGGAGGGAAGTGGTAGTTAATAAGTGAACCTG

TAAACCAGCGTTTCTCAAAATGTAGTCCAGGGAATTGCATCAAAATTGCAGTTACCTACAGT

GCTTGTTAAAATGCAGATTCCTGGGCCCCTGCCCCAGGCTTATCAAATCAATCTGGTGAGTA

GGACTCAAGAACCTGTAAATTCACATACTTCTGCAGATGATTCTTCTTGCACTGCACAGCAT

GAAAGCCTCTGCAATAGACAGAAAGCTACCAGCATTGCGAAAGCAACTTGAGTGCTTGGCC

TTTGAAGGTTGAGTGGGACTTTAATGAGGGAGAGAGTAAGGCATGAGAAATGGCAGTTCCA

CTGAGGTCAGTCAGTGGTTCATTGCTGACGAAGTCACTTTTAAGTCATGTTTTAGAAGAACT

ACCAAGTGTGGCAGGTCAGGCATGTGGCAGGACTGTTTCTGAGCACAGATGAATGGATGAG

CACCTGGCCCCACTGTGCCCAGTTGGTCTAGCTTCCCACTTGGCCACCTACGGTCTGCTGTGT

GGACCTTGTCTGGCAGTCTCCTTTAATTTATTTTTTATTATTTTTTTCTTTTTGAGATGGAGTC

TTGCTTTGTTGCCCAGGCTAGAGTGCAGTGGCATGATCTCGGCTCACTGCAGCCTCCACTTCC

CAGGTTCCAGCGATTCTCCTGCCTCAGCCTCCCAGGTAGCTGGGATCACAGGCAAGTGCCAC

CACGCCCAGCTAATTTTTGTATTTTTAATAGAGACATGGTTTTACCATGTTGGCCAGGCTGGT

CTCGAACTCCTGACCTCAGGTGATCCACCCATCTCAGCCTCCCAAAATGCTGGAATTACAGG

TGTGAGCCACCGCACCTGGCCTATTTTTTTTCAGCAAATTCTTTGTTTTTCTCTCTGTTCCCAA

ATGCAGGGTACTGAGACCACAGATGTATTCTGTTTCCTGTTGAAAAAATGTTTCTCACTTAGC

-continued

TGGGTGTGGTAGCATGCACTGCAGTCCCACGGGAGGCTGAGGCGAGAGGATTGCTTGAGCC

CAGGAGTTCGATAATCATGCCATTGCACTCTGGTCTGGGTAACAGAGCGAGAAACTGTCTCT

TAAAAAAAAGAAAAAGAAAAAGAGGTCCTAGGGAAAGAAACAAATAGTGGCTTGGATGGT

GAGTTGGTGGAAAGAACAGTGGGTGTTGGGGGTGTTGAACTTGTGTTTGTGTGTGGTGTACC

CAAGACATATCATGTCAGCATTAAGAATAGACTATTCCTGTTTTCTGGTCACTGAGTTGTATG

TTTTGACATCCTTATTTTGGAAGATACTTCCTTACTAGGAATGGGATAGGGAGGGGGTCACC

TTTCCCATCTGTGGGTCATATTTTAAAATATTTATTGTTCAAGTTTAAAGATATAACCAAAGG

TATAAAGAAAAATACCACAAACATCTGATTTAAGAAACAAACCAGCCGAGCGCGGTGGCTC

GTGCCTGTAATCCCAGCACTGTGGGAGGCCGAGGCAGGCAGATCATGAGGTCAAGAGATCG

AGACCATCCTGGCCAACATGGTGAAACCCCGTCTCTACTGAAAATACAAAAATTAACTGGTC

ATGGTGGTGTGTGCCTGTAGTCCCAGCTACTCGGGAGGCTGTGGCAGGAGAATCGCTTGAAC

CCAGGAGGCGGAGGTTGTAGTGAGCCAAGATTGTGCCACTGCATTCTAGCCTGGCGACAGA

GTGAGACTCCGTCTCAAAAAGAAAAAAAAAAGAAAGAAATCATTTCCTACACCTTCGAAGC

CTTCATGAGTTAGATTTTGAAACAGTGCAAAATGCTTCACGTGAGAATCGAGAGTCCCTTCT

GGTGGCTCTCCATCCCCTGCTCTTCTGTCAGGTTTTCTTGTAGGTTTATGGAAACCTTTGTTAC

TTGTGCAGGTGGCAGAGAAGCAGAGAGGATAGCTGCGCGCCACCCACACAGCTAGGATTTA

TTGGCGTACTCCCACGTGCATGGCAGCCAAGTGGACACAACTCTGTGATGAATCCTCCCAAG

AGAACTGAGGGGCCCTGATGGAGGAGCTGCTTCTTTGCAAAGCTTTCCTTGACTCTCTTCCTG

TCCCCTAGTTGATTCCCCTTCTGTGCTAGTTTTAGCTTATTGTTTGTTACCTGTCACACTTAGC

AGTACTGTTGGCTTTGCTGGTCTCCTTGACTACTGGGGGTAAAGACCTTTTGTTGTTGTTGTT

GAGACAGAGTCTTGCTCTGTCGCCCAGGCTGGAGTGCAATGGCGTGATTTCGGCTCACTGCA

ACCTTCACCTCCCAGGTTCAAGAGATTCTCCTGCCTCAGCCTCCTAAGTAGCTGGGATTACA

GCTACACCACACCCGGTTAATTTTTGTATTTTTAATAGAGATGGGGTTTAGTAGAGATGGGG

TTTCACCATGTTGGCCAGGCTGGTCTCAAGCCCCTGACCTCAAGGTGACCTGCCTGTCTCAGC

CTCCCAAAGTGCTGGGATTACAGACATGAGCCACCATGCCCAGCCTCAAAGACCTCTTCTTT

ACTTGCTCACCCTGCCGCCCACTCCCCTACCAACCCCTGCATGCCCTATACCACCTGGCACAT

GATACATACTAACTGGGTACATGTTTGAATATGAATGGATGTGGTGCTGTGAATGCTTAGGG

GAAGTGGGTGAAATGCTTAAGAACCAACCTTGAGTGGTCTGGGAAGGCTTCCTGGGAGGGT

GGTGTTTGAGCTAAGGCCAGGCAGCTGTTAGATTTGTTAGACTGAAGCCCTTGCAGACTTAG

AGAGCTTGTGCTCTTCCCAGAATGACGGGTGAGCCACGTACAGTAAATGGTGCTTCTCATTT

CTAGCCCAAGGGGCCTCAAGGGGCACCGTGATTTCACGAGAATGCTGCAAGCAAATCTTTTC

TCAAGCTGGGGAATTTGGTGGTAATGCCTGGCTCAGCTTGCGGTGCGCACCTGGCCTTTGGA

AGATTGGTACAGAGAGAAGCGGCCCATCCACATGAGCCTGTGGAACAGCACTGGTGGGGGA

GCTGATTTGTGAAGAGGGGCTGTGCAGTGTACTGTCAGGTCTGAGACCCAGGAAGAAATTCC

AGTATCCCAGCTCTCAGAATCACAGAGTTCTAGGCACTGCCTAGTTCCACGTGTTCCCAAAT

GTTTCCTGAATACTTGGATTTCCTGTCCAGAGAATTTTCAAAACAAACTTAGAGGCCTGACC

CATGGCTGCCAAGGAAGGATTTTTTTTTAAATTAAATTTTAAAAATCAGTCCAGCATGAAA

ATCTATGATGATTTCATAAGAGAAAGGACATTTTAATATTCAAAGAGTAAGAAGCACTTAAT

CTTGGAAGAAAGGGCATTCCTATACTTTGATTACCTTTAGTTTAATTAAAAAACACCTACAT

GGTCTTTACTTCTGTGATTTCATTCCTGGGCTAGTGAAACATTGTCACAATAAAGCATCAGGC

-continued

CAACGCTTCTTTCGACCCACTGGCCAATCAGTTGACAAACAGTGACTAGATGTTTCAGCCTA

TTTTGCTGAGGCTAAAGGATTGAACTAGTGCTTCAGCCAGCATGAAAACCAGTCAGGAGTCC

GTGCTGGTGTTGGCTTAGATTAGCAGGGCCTTTGATGGAGGGGCATGTATGTGTTTGGGTTT

GCTGTGCCAGGCAGGGGAGCAGTGGAATTTGTCTGAATTGAGCTCACACATTGAAGTTATTG

AGCGACTTACATGCAAGGCCATGACCTGGACTCCCAGCCGAGAGGCCCACGTGGCGGGGCT

TGAGCTGGGGGAGCCGAGGACAGCTTACATCTGCTCATCTGCTTACGTAACCCTGCCTCCCA

GCTTCCAGAGCCAAGAAAACACACAAGCCAGCCCAGCGGGGCCGAGAGCCTGTGGTAGCAC

ACGCCATGCGCCGCACAGCAAGGGCGCCTTGGCTCGGCTTGAGGCCTGTCATGAAGCCCTCA

GCCCTCTGCCTCCTCCCAGAGCTTCTCCCCACCACCCCAGGCAGTGGCTCTGAAACCTGGTC

GCAGGTCTGCATGATTCTGAACAGAGGTAGTCGTTGCCTTCCTGGAGTCTGAGCTCTCTGGA

GTTTCTCACTGGGACAGAGCCAGGTGTGTAGCAGAGCATGGTCCCTGCAGTATGGCAGGAG

GTGTGCAGGGCATTCAGGAGGCCTCCTGGCTGGCACTCGACCCAATTAGTCATTCAACGCCA

GGTCTGGGGCTGCTGTCTGTTGTCTCAAAGGTGTGAGCTGCAAGATCCTTAGAGTTGTGGAG

AAAAAATTGCCAGATTGGCAAGAAGGGCAGGATTGGGGGTCAAGGTGTCTCAGTGTGTTGG

AAGCATGATGGGGGTTGTGCAAGGGGCACAGCGAGTTCAGAAGGGAGCAGGAGAGTGAGA

AGAGGCTGTTCAGTGATAAAGCTCTGCACAGAGCCATTGGAGGAGCAAGCTCCTTGACCATC

CTTAAACCAGGGTAATTTTCATTTAGGTTCTGCCACACGCTCAGCAGGGAACTCCTGGAAGG

CAGGATTTGTCTTGTCCATCCTCCCTCCCTACCTCAACCCACTCCTCCTTGGGCTGGCACACA

GTAGGTACCCAGAAAGTATCAATTGAAACAAATTGAAAGTGGTCTTGATACATATCACAGG

GCAAGTTTGCAGTTAACAGACATTTCAGAGTAAAGACTCTCTGGCTTGGTGCTCGATCGGCT

TCTGTGGGTTGTCAGCATGCTGTGGACAGCCCCGGCATGGGAGCGAGTGGGCGTGTGTGTGT

GTGTATGTGAGGGTGAGAGAGCGTTAGTGTGTGTGTTGGGGTTGGGGAGAGAGGAGGGGGA

ATAGAAGATGGACCACCCGGGTATCAGCTTCTGCCCTGGGGAGATGGTGGTGTCAGTTGCTG

AGGGAATCCTGAGAAGCAGGTCTGGCTGTAGGTGGTGATGGTGGTGGGGTTGCATGAGAAT

CCATTTGGGGCAGGTTGAATTTGAGGTGCCCATGACATATGGCTAGCCATGTTCTGTTGGCT

GTGAGGTCAGGAGAGAGACATGAGATGGAAACAGAGGTTTGGGAACTGTCATGTGCTTAAA

CCAAAGACCTGGGTATAGGGAGAGTGAGAAGAGAAGGGGGCAAAGATGGACATCCAAGAA

AGAAGCTGAGAAAGCCTAGGAATTTGAGGTAAGAGGAGACGTAGGTAAATGTGACGCTTGG

TGATCAAGGCTTCTTTCCACCTCTCCTATGCTGGACACTCACGTCTCCTGTCTGCTTGGAAAT

TCATGCTGAGGGCAGGGAAGGTGGGAGCAAGGATTTGTCTAAAGATCTTGCTTTGGATCCCT

GCACTCCTCCTGGTTTACCAAGTGTCACTGGACACGTCAGGGCGTTCTGAGACCTTAGAGAG

CATCCAGTCCTGTCCCTGCAGTTTACAAATGAGGAAACCAGTACCCTGAGAGTGGCTGTACT

ATCCACTCTCAGGATACCAAAGATCATCTGGAAAGTCACTGGTGGAGCTGGACCGGGGCCC

AGGCATCTCTTCTCCTGTCCGGGGCTCTTGACTTCAGGACCACCTTTCTGAAACCCATGATGG

GGCAACACCAGGACACTTTCCAGCCTGCAGGTGTCTGTCCCGCGGAAGCGAGCCAGGCCAC

ATGTGAATTCCTGTTTTCTGGGTGGGTTTCAGAAGGTACGAGCAAGTCGGCAGGGTGACAGC

CCAGGTGCTTCTTGGGTTCCCCAAAACGCGGTTATGTTTAGCAGCATCCTCAGAACCAAAGG

TGGGGTGGGGGCTGCAGATGTTGTGGGGGCCCTCTGAAGTGAAAAGAGCCCTGTGACAGAT

CTTTTCTTCATGTTTTTCACAAGTTCACTGTGCAGCAGGGCCCCCCCAGTAGCCTTTGCCCAG

GGTTGGGTGTTGGGCAGCCCAGGCCTGGCTGACCTTGTGGGGAAGGGTGTGAATGGTGGGA

ATCCCCGAGGGCCCTCTTTGCCCGAAAGCCCTAAGCCTTGACATCAGATGCCCATCAGATGG

-continued

TCCATCGGAGCCCTACTACCCAGCTTGCCCAGTGAGAATCATCTGGGCTCCTTGTTAGGTAG

CCATTTAGGTCCTTCCCAAAATCCACAGACTCTCTAAGGGAAGGGCCCGAGATGCTGTACTT

GTACTAACTTCCTCAAGCAATTCTTGTGATAGGTTTGGGAAAAACTTGTCCAGGGTGACCAC

TGACTGAGTCCTGGTCTTCTCTGAAGAGCACAGTGCCTGCTCACTTTAGGGCACCCTGGGAG

GTGGGAGCTGGCTCAGCAGGCAGTCTTATAAGGGACTGAGCTTCAAGGCCTCTGTCCCTCCA

GGAGGGAGGTGCATGACCAGAGAGGGAGGCCTGAGGATCTTCTTCCCTGCCCCAGAGGGTC

TGCTGCCTGAGCTCTGTGATAGCGCAGAGAGTAAAAGGATCAAGCTTGATTGAGGCCTATCT

CTCAATGCGAAAGTTTGCTAGTTAAGAGGAGAGTGGGAAGGGCATTTCTGGCAAAGAGAAA

AGTGTGGACAGGCATGGCTTAAGGGATGGGGAGGGAGACAGACAGAGCTGAGGGTGAAGG

GCCTTTTGCTCAGCTGTGGGCCTTGGCCTTCCCTTGTGCAGGGACACACAGCCTTAGAGCCA

CTGGAGGTTTTAGTGGGAAAGTAATATGGTCGGGGCTGTATCTCAGAAGAAAACAAACTAA

TGGGAACAGGTCCTGTGATGGTGGACCTGGGTCAGCTACGGAGGGAGGGAAGATGTGAGAT

GTGTACTGGGGAAGGGGGTGGAAGTGGCAGCTATCTGGTGAGAGGAAGCAGGCCCACAGCT

TTTTTTCTCAAGCTGTTGAATTCAGAAGGGCGAGTGATTCCGGGAGTAGGGGGTGCTTGGAG

AGCCACGCGTTATTGATAAACAGGGCAGGCTGAAGCCTGCTCACTGGCCCTGGGCGGGTTCT

CACCAGCATGTTTCAGGTTTTGATCTGTGCTTGTGGTTGGTGTTCCTACCTGTTCTCTAGGTTC

CTTCCTTTGTTCTTGTGGCTCATTTGCTTCACAGGTGAAGCTGGTTACACTAGAGTAACAGTT

CCCAAAGTGTGTTCCCTGGAAAAATGGTTCTGTAGCCAAATAAGCTTGGGAAATGGTGGGTT

AAATATAACGAAGGGGGTTTTTCGACTGCACAACTTCTCAGAGCCTTTGGTGTGTGTCGTGA

CTTTGCAGAAGCAGGATTTAATACGCAGCATTCCCGTTCTTATTTGACCACGAGACATGTTTT

TCCATTAAGCATCTTGCTGGGTCTGATGTTTTCTGGAACCCATTTTGAGGCGGTCTGGTCTGC

AGAGAGTATGGGGAGCCTGGGTTCAAGCCTTGGCTCTTGACTCTCAGCAGAGCCTTGATTCC

CTGTGTTGCCTGGACTGCACCACGTGTACCACATACCCGGTATGTGACGTTTTCCTCATCCCT

CTTCCCACCTGCCGTTACCTCACAATCCACAATCTGCACCTCATCCATTTTTCTTCTGAGGCA

AGCACTCTCTTACTAACTTACTTATCTCATCTGCATCCATGTTCTTCTAGGCCAGAAACTTGG

GAGTCATCCCTCCCTCTTTGTTACTTCTTCTTCCTCTTTGTTACTTTATCCCCTCTGTTACTAAA

CATTCTTCTGTGTTTCCAGCTATTTCTTTTATTTTCCCTCGGTCTCCTTTGGGGTTTCTTTGCCT

CCATCTCTCCCAGACCTTGGTTCACCTTCCATCGAGTCCCTTCCTGGGACATGGGCACTCATG

CCACTCCTGCTACCTTCCACTTCGAAGCTAACTCCCTCCACACTGACGTCCCCAACATGCATG

CATACACACACACACACACACACACACATACACACACACACACACACACTTCCCCAGTTAG

GCTAGAATCAGAGAGATGATGTCAGCCATTTGTCCAAGGCCACGCAGCTGGGAGGTCACAG

AGCTAAGTCTCAACCTCAGGGGTTTTGAGAAATTGCCTTCTCATCCGTGATCACTGATTTCTA

CAACAGCCTGTCAGGAAGTCTGGGTAGAAATTACTTCCATTTTACAGTGGAGTCAGAGCGGG

GAGGGTCCTGGGCAGGCGAGTGCTTCACAGAGTGACCAACCATCTAGGTTTGCCCCACACTG

AAGGGGGTTTCTGGGGATGGTTGGTCACCCTAATGCTGGATGTGGTGCCTGATGCTGGGCAG

GAGGGCCCTCTCCGTGGCCACGTTGCCTCCCAGGAGGAGACATTTCCTCTGCAGCTGCAGCT

GCAGCCTGGCCATCTGATGCAGCCTGTGGAGCGGTGGCGAGTCCTGTGGCCTGCTAACTTCT

CCCTCCCTCCACCTCTCTAGTGGGCCCCATGCTGATTGAGTTTAACATGCCTGTGGACCTGGA

GCTCGTGGCAAAGCAGAACCCAAATGTGAAGATGGGCGGCCGCTATGCCCCCAGGGACTGC

GTCTCTCCTCACAAGGTGGCCATCATCATTCCATTCCGCAACCGGCAGGAGCACCTCAAGTA

-continued

CTGGCTATATTATTTGCACCCAGTCCTGCAGCGCCAGCAGCTGGACTATGGCATCTATGTTAT

CAACCAGGTGAGGCCTGGGAAGGTGGAATGAGAGAGGGTGTGTGTGCATGCAGATGTGTAT

CAGATGTGTGTGTAATGAGGGCAGGGGAAGGGGAGTGATTTCACAGACACCTGGCACTTAC

AGCGAGGAACCAGCCCCCCAGCCACCACCAGTGCAGATGAGGTAAACGCCAAACAGTGTGC

TTGCCTATTGCTGTCAACTCTATAGCCAAGGGAAATGCTGGAGTGTTTTCGTTGTTCTGTTTT

TGTTTTCTGGAAGTAGCCTTCCAGCAAGATTGGGAAAAAAGACAACCCTAATTATTCCAAAG

TACACACTGATTATTCCCTGGCTTTGTGTAGCTGTGTATTTTCCTTTTAAAAATAAAACCACC

ATTTAGATGTCAGACTTTTAGGTAACTTCAAAGTTTATCCAGTCAGTCAGAGCGTGTCTCCTG

GGGCACCTGGAGACAGTGCCCTTAGTTCAGGTCACATGCCTACATGCCAGCCCCTGGTGAAA

TATCTGGAGAAGTCTGATTCGTGGGCCATCTGAGAGTTATGTGGACTGGGCCGAGTCTGAGA

AAAAGTTTCTCACTGCTCGTCTGATCCATATGTGTTGGGCTTTAGCCCTGCTTAGGAAAGTAA

TGCTAAGGATAGGTCAACTTTCATCACCATGGCATGGAGAATCAGATTGATCTAAGAGGCAT

CTTTATTGAAATAAATTTTTCAGTTTATTTGAGGAGCATTATTTTCCCAAGAGTATAACTTTG

ATATTTCAAGATTACCCCTAACACTTAAATTCATGTTTTTAGACTATAACCTCCTAGGTGCAA

TGACACATCTAACTTATCTAAGCACCCAGTTTCATTGAAATTCATTTGAAGAGTCTGAGTAC

GCCCATTTCTACAAGGCCCAATGTCCATTTCATTTCGAGATAAACTCTGCTTTAGGTAGGAG

GATTGTTGGCAGTTTACGGCTTCCATCAAGGTCAAGGAACTCTGTGCACCTTCCCTATGACCC

CAGGGGAAGCACTCGAGGACTGCTGTGGCATTGTGCTGCATCACTTGCTGCAGGGAGATTCT

GAAGAAGTGTAAGGTCTCAGTCCTGCCCTGTCCCGAAGCCTCCAACCCACTTCTGGCAAGTG

GGACCTTCCCAGGGAACAATTTGTTAACAGACCCAAATATCCTGTGATTGGATGGTGGCTGC

CAAATGCTTTGGAAGCTCAGAGGAAGGAGAGAGAGCAATGGCTTGGAAGAACCAGGATATA

AACTAGGTTCTAAAGTCTGCAGGGAGATGGGCTTCTCAGCTGGGGCCAGTGAGCAGGGACC

TTAAGGCAGAAAGGAGCCTTGCATGTTCCTGGAAATTGAGATGCCCACTGGGGTAGGAAAG

CACCAGAAGCTCTGGGACCAGGTGTCAGAGTTAAGCCTGTGAGGCAGGAGAGAGCAGAACA

AGCCCTGTTACAAGGAAACTGAAGCAGGAGAGCAGGTGGTGGGCAAACCCCCTTGAGGCTGT

TTGAATTCTTCGGCCAAGTGAGGTACAGACCAGGGCCCTATGAACACCTGCAAGCAAGACA

GCCACGCAGTTGTGGGTCACCTTGGAAGAATATTGGAGAATGCAAGAGAGAACAGGTAAAT

GTCCTGCAAAATGCGGGTCACTTTAACCCAACACATATTCATTTAAGAAAAGCTCTGTGATT

GAGAAACATTTGTCTGATGCCAGTTAGCACATACCAATGACGGCAAGATTCAGGAGCCTGTT

ATTAAAGCAGTGGCAGCGAGCACCTGGAAGAGGCGGCCACCATCACCAGGAGCCAGCAGG

GATGACTAATAAGCCGTGCCAGCTGCATCTCGTTTCTCTCTTGACAGTTGCTATGCCAGTAGA

TGAGGGATGTACTGTGGATACAATGCTGTCATATCTTATTCAGCAGGGCATCTGATAGCATC

CCACAAATCTGCCTGAGTAGAAGACAGACAGCTGTGGTCTGGGTGCCATATAGGTAGGTTA

AAATATATATTTGGGCCTAGGCGCAGTGGCTCATGCCTGTAATCCCAGCACTTTGGGAGGCC

AAGGCAGGCGGATCACTTGAAGTCAGGAGTTCAAGACCAGCCTGGCCAACATGGCGAAACC

CCGTCTCTACTAAAAATACAAAAATTAGCTGGACATAGTGGTGGGCGGCTGTAATCCCAGCT

ACTCGGGAGGCTGAGGCAGGAGAATCTCTTGAACCCAGGAGGCAGAGGTTGCAGTGAGCCG

AGATCATGCCACTGCACTCCAGCCTGGGCAACAGAGTGAGACTCTGTCTCAAAAAAATAAA

ATAAATAAATAAATAAATAAAATATATACTTGGGTAAAGAGGATAAAAGAGTTAGCGATGA

TGCTGAATTTTTGAACTGAGGTGGCTGTTTTCAAGGAAGACTGGAGGGTGGGATGCTACGTC

TAGATATGTTGCAGTTTAGGTGAATGTGAGACTTCCCTGTTTTGAAGTCAAATATTGGACCA

-continued

GTAAAATCTAGCCATCAGCTTAAATTCCTATGATACAATTTACATACTCCCCAGGCTCAACA

CAGTAGATTTCTGAATGTCCTCTGCCAGCTACATGCTCCTGCCCACCTCAATCCGAGTAGATG

GAACAACTAACCAAGCCAGCTCAGACCGGTGGCACAGCTGTGCTGGCTAACACTGGGCACC

ACCTAAGAGAGTGCTTCTCCAAAAGTGTGCTTCCCCAAATGGAGCGAAATACGCTTGAGGA

ATGTTGGGTTGAACCATGTAAAGCAGGTCTCATTCCCGCAGAGCCTTTGGTACCCCGGTGTA

CACTGTAACCCCAGAAGTGTTTCCTGAGCTTGCCTGACGAGACAACTTTTCCAAGAACCGTC

TCAAGTGATGAGTGTTTTGTGAGTCACACTTTGGGGAAAGCGGGCCTAAGTTAGCATCTCCT

CCCAGCTGCCTCCCTGCTTTCCCTGGAACACTAGGAACTGCCCGTCCTCCCTCCCTCCCTCCT

CTTCCCACTTCACAACTTAGCATCAGGAATATTTTAGTTTTGGTTTTTCAAACATATATACCT

CCTTTTTTCTTATCTTGTCAATATCATCTTTTTTTTTTCTTTGCTTTTCCTCATACTTTTTTTTCT

CTTCATCCTTTCCTTCTCCAAGGGTTAACTTTCCACCTTAGGAGAATCTTTTCTGCTTTTTCTC

CCACTTCCCCAGCTACTCTCTTATCATCTGCTCCAATCTCACCCTAATTGATCATTTTGGGAA

AATATGGTCAGAGTCCAGATAACTAAGTTGAGAAATGCTTAAACTCTGCCATACCTTTCCAG

TAAAGAATATTACCTAATAAATAATAAAATGGTAATGGGAAACCTGAACCCTGAAAAAAAA

GAGGTGGAAGGAGAAACATTTGGAGCACATCCTGTCTACAAATTAGGAACTGCCTGTGTTAT

CTGTTTTATGGTTATATTCTAGAAGAAGAAAGGGATTTTGTAGCACCTGGTTTTGACCTTTCT

GCACTGTTTGTTGAGCAAATAAACCTTATGGGCTGTTAGCCCTCTTTATAGCCTCTCAGCTTA

TCCCTGGCCCAGACACCCTGCTGTCATTTTGACTTTTCATTCCCACACACACATACACATGCA

CACACATGTACACACACACACATACCATTTAAGATTAGACAGAAGTAATGCTCAAAATGGA

GTGGCTTCTGAGACATTTAGTCCAAGGGTTCCCAAACAGGCTTTTCAGTATCAGATTTCTTTC

TGCCCCATTGAAATGCTACACAACCTTCCGCTTACAGCAGGTCACAAGGGTTTCATTCTACTT

GAAGTAGGGGCCATGTCCCATTTCCACTTCCTTGGCTTCCCATTCAGTCACTGCTAGGATTTG

CCTAGACCCCTGAGGCCAGACAATGTAGAAACTTCTGCTCCATGTCACAGGTGAGGAAACA

GGCTCAGAGAGGGACAGGCTCCGAAAGTCACATAGACAACAGTAGGGCTGCGGCTCAAACC

CCAGCGTCTGACTCCAGGTTTAGTGCCTTCTCAGGGCATCAGTGACACTCCTCATGGCCAGG

GTGCCCCCAGTGTTGCTCACAGTCTGGTATCCAGGGCTGAGAGTGTGCTGTGTGCTCAGACT

GCCTGGGTTCAGTCCTGGCACTGCCACTTTACAGTCAGTGACCTCAGGCAGGTTACTTAAGC

TCTGCAGGCCTCAGTTTCCTCCTTGGTGGGGAGGGTTATGAGGCATCCTTCTCATGGTAAACC

TTCAGTAAATACCAGCCGTTACTAGGAGGGTCCACTCCTGCCTCTCCACTCTCCATTCATCCT

GCCTGTTTCCTCTGCCTGCTTCCTCTGCCTGCTTCTGTGGTGGTGAATTCTTCATGGCTCCCAC

CGCCTCCTGCTGCACCCCCACTCAGGGCCCGCATCAGGACCCTTCCTCCTATTGGTTTGAACT

CCTTGGAGTCAGAGGGTAATGGATAGTGGAGTGAGCCAGGTGGCAGAATCTCAGAGGCCAT

CCCGGGCCTATAAGCCTCTTCAAAATAGGGCCACGTATCAAGCTTTACACACAGGAGTGAAC

TTTCACAAGTTGTTATGACTCATACTCTGTCTATAGTAAGCTGTTAACCACTCCCATTTGGCT

TATGCCTCTGTAATTATTGTACTAACTTATATCTTAAAATAAGGATATTGAAGGAATGAGCC

GGGAGAGGCTTTCCTGGTTGAGATATAGAAGAACAAGAGTTGCTCTTTTTCCTTAAGGTCTC

TCCTCCCACCCCTGACCTTAGCTCACCAGCATGGGAGAATACTATTTGACTCCTTGTACTCTG

AGACGTGGATTTCAAGATATAGCATTCCAACTTCAACGGCAGCAAGAAAAGAAGCAACAGA

AGGAGAAGACATCATAGCAAACAGGGATGCATGCTGCATTTCCTAATACTCAAACCCGGAA

ACGAGACTTCACTCAAGGTGAAGGGAGGGCAGGTCACCACCTGGTAGCACTAGCCCTAAAT

-continued

TAAGGAATGCAGAATGTTTGTGGGATTGCCCATCATAAAAATTACAAAATGAGTAAGGAAT

GCAGGCACAGCTGGCCAGGTGGGTTTGTCACAACCATGGCAGCCCTTTGCCCCACAGCCAGT

ACACAGAACTGGTCTCTCCAATTCCGATTGCATATCTTCTGGCACCTCTGTTCCTCTCCCTCA

GCTGCCCAGGATTTTTCTGGTTCTGACCATGTTACTTCCTCTTTTAAACCTGTTAGCATTTCAC

GACTGCCTACAGGCAACGGTCTAAATGGTCGGAAGGCCCAAGCTTAGCATCCGAGACCCTG

ACCTACCTCCAGCCACTTCCTCCTCCTCTCCACTTCACTGGACTCCCCATCTCCACCCAGACA

CCTCTGTTCTCCCCTCTGTGTGCCTTTGCTTATGCTGTCCCCTGTGTTCCTAGTGTGTCTCTGG

CTATCTTTTAAGCTTCCCTCCCCAACCTCATTAGTTCTGTGGAGCCCCTGGAATAGAGCTGAC

TTCTCCTTCCCTGCTGCTCCCAGGCTGCTCAGAACTTTCTGGAAAGGGATGATTATCTGAGTT

CCAGCCTCACCCCAGCCCCCGGACTCTGAGTCCCTCATGTCTGCCTCCCTTCTTTCTCTCTGA

CCACACAGCTGGTACATAGTCAGTACAGACGCAGTCAGTGAGTGGAGCACGGGGCTTCTCTC

CAGGATTCCTGCCCCTTTGTTTATCCCTAGTCTCAGGACTCCCTACTCCTGGTCTTCTGCCTAA

ATCTGTGCCTCTTGGAAGTGAAGCCTCCGTTCCCAGTGGGGCCAGGTCCTGACCCTTGGGAA

CTTGCAGGATCCCTCCCTTGGGCCTCTCCCCGAAGCTTCCAGCTCAATGCTGACCAGAGCAC

AGGCTGCCTGTGACAGTCCTTGGGGTGACCTCCCTTATCAGGAAAAATGCAGAAAACCTATT

AATACCTTAGCCTTGTGATTGTTAATGGTCACAAAACTCCTTTAGGGTCCTTTGGACTCAGCA

CCTTTATGGTCTCACTTTGAATTTTGAACCTCCCACCTCCCCCCATCCCCCAGAGTAAGGCAA

ATGGTCTTCTGATTGTTCCTGCAGAGGGAAGGCTCCACAGGTAAGCACACGATGGCCAGGA

AGCAGAGCTGGAGCCTGCCTGAAAGGCTGTGGAGAAATGGAGGGAGGGCTGCCCTGAGGAC

TCTGTCTGGCTTTGAAGTTTTCTACTGTTTCCTTTTCTTCTGTGCACTGTTTTAGGATGATGGG

GTGATAGTTCCAGGCTGGTTGAGGATGGATTTGGAGACAGTCCTTTGTACCCTCAGTGAGCA

AGAGTATCTGTCACCCTACCTCAGCAGTTGTCTCTGTCACTGGTCCAAGCAGCTGGTTCCTAC

ACAAGGTCAAGATCAACTGGGGAGAAGCAGACTCCTGGGTCTATCCCATTAGTGAGGACAG

CTGCCTGGGCTTATGGCCTCATTGGTTTGGTTTCTATCTTGATCATCTCTACCATCCCCCCATC

CCGGCCTTCCATTTTCTACCTCAGCTGTCAGTGCACAGATTGATGTGTGTGGGAACGGAGCTT

GGGAGGAGTGGGGTAGGGCTGGTCCTGTCCTGTAGCCTCCCCTTCCTTCGGGCACTTGGACC

CTTTGGAGCTTGCCGGGGTGGGGAATGGGAGTGGGAAGGCCAGGGAGTGTCTCTGCACCAT

CACTGTTTGAGTGTTGCCCCTTTGCTGTGTGCCCCACCTAGTCTATGTGTGTCTCTGTTCTCTG

GGGACTCAATTTGCTGGTGAATTGCTTCCATGGACATTGTTCTGGGAAATGCCATTTTTTCTG

CTCACCCATGACTCTGTGACAAGGAATGACAGCTTATTAGGAATTTGTTTTTGCATTGGAAC

AGTGGTCATCAGAATGGGCCCCTTTTCCCTTGCAGCTTTGACATTTGCCTCTCTTTTCCTCACC

TCTCTCCCTTGCATCCACCCTTTTCTCTTTTTCTTCTTTTTTGTTTTCCTTCTAGCAGGGGCCTT

TTACCTTTACTTGTTAATCCTGTTTGTAGCAAAGCAAGTGGAAGGAGGAGTTCCTCTCTGATC

TGCTTCTTATTCTCCACCTACCTTCTCTTCTGTACTTTCCGCCTCCTAGAGAGAGAGAGAGAG

AGAGGAATGCCGACCTAACTACCGCTGCCACTGCTGCTGCCACCACCGCTGCCACCACCACC

CTGGTAATGTTCACATGTCCTCAAATCAACCCAGAGCCAGGGCCCTGCTGGTCAGGGGGAGG

CTATGTAAATAATCCCATGAGTGTGCCATCCTCAGGCCCTGGGGTCTCCTAGGCAAGACCAG

GGCCTCTGTGGGCTCTCTCGGAAATGCTGAGGTTGCTGGAAGCCAGCCCGTCATACAGGGTC

TGAGAGTTTAACTTCTTTTAAATTAAACCACAGTTGAGCTCATGCTGTGTGTGTATAAACTTT

TGTATCCTGCTTTTTCCTTAAATTCTTTATCATCAGCATCTTCCCATGTTATTTCATAGTCTTC

ATCATCATCACTTTCCATACCTTCATAGTAGTTGATCGTAGAATTCCATCATAATTAACTTGT

-continued

CTTTTCTCTCTTAGAAGTCCCTTAGGTAATGTCCAATTTTCCGTGAGTGTAAGTAATACCATA

ATGAACATCTTGGAGTCTGAAGTTTATTCTGTGTTGGTTTGTTCCACATTTAGGATCATTTTC

CCAGGCTAGATTTTCAGATGTGGGATTATGGGTTCAGATATGGTTTACACATTTTTATAGTTC

TTAATACAGATGGCCAAATTGCTTTCTGAAAGAGAAGCTTTTCTTAAGTATTTTTCTCCAACT

TGTATCTTAAACATCCTGAACATGCTTAGCACCACTGTCTTGATATATCTGCGGAAAGCCAC

GTCTCCACTTTTCAGTGTGTCGGGCCCTGGGAGAGGCAGGCATCCTGCGCTGGCTCCTTGGA

GCTGGGTTTAAAATTGTCTCCTCTGGCTGGGCGTGGTGGCTCACACCTGTAATCCCAGTACTT

TGGGAGGCCGAGGTGGGCGGATCACTAGGTCAGGAGATCGAGACCATCCTGGCTAACATGG

TGAAACCCCGTCTCTACTAAAAATACAAAAAATTAGCCGGGCGTGGTGGCGGGCACTTGAA

AAGTCCCAGCTACTCGGGAGGCTGAGGCAGGAGAATGATATGAACCCGGGAGGCGGAGCTT

GCAGTGAGCCGAGATCGCGCCACTGCACTCCAGCCTGGGCGACAGAGTGAGACTCCATTTTA

AAAAAACAAACAAACAAAACAAAAAAACAAACAAACAAAAACTGTCTCTTCTGTGCTCACT

TCACCCAGAATCCCTGTTGGGCTCTTCAAGGAGCTCAGTTCTCTCTGAAAGCAACTTTATAGC

CTCAGTCCAGTCTGTGTTCCTGTGTGGCAGGGGTCAAGGGTATGCTCACTCTTGAGAGTGGT

GTCTTTGGTTGACCAAGAACCACTCCCATAGCCTGGTCCCTAACCCTTGAAGGCCCATCTCTC

TCACTCACTGGGGTGAAGAGTTTAAATCTCAGATCCAAGTTTTGTTGAGAGCTCTGAGCTAC

CATATTGCTATGGTTAACAATAGTTAACAATGTTAACAATGGTTAACTATGGTTAACAATAG

TTAACAATGTTTAACAACTAGAGCCCAGCTGGGTGTGGTGGCATGTGCTAACAGTCCCAGCT

TCTCAAGAGGCTGAGGTGAGAAGATTGCTGGAGTCCAGGAGCTCAAGGCCAGCCTGGGCAA

CATGGCGAGACCCTGTCTCCCCTGCAAAAAAACAACAACAACAAAAGCAAAACTAGAGCCC

AACTGCTGTGAACTCATGGCTGAGTAGATATTATTAGCCCTCCACAAACTCAGCATTTGTAT

AATCCCAGGCTGTTTCCAGTAATTCTCTGGGGATCATCTCCCAGCCTGTCCACTGTTCCAGGA

TCCACACTTAGGCCTATAGGAATGCCCCGTCAGAGCTTCTGCTGCCGCTGATCTGTTACTGTT

TCATGCAACCCACTCGGCCTAGTTCCTTCCTCTTACTGTCTCAGTGGGCACAGAAAAGCATA

CAGAGGGTGTTTCAGCAAACATTGCCACTGGCTGCAGACCTGCCCCCGGATCTGTCCTGTTG

AGAGCTTAGTGCTGCGTTCTTGCATGGTGGGGAGGGGTGTGGCTCTGTGATGAGCCAGGGCA

TGTGTATAGGAGCAACAGTGTCTCTCTTATCACGTAGAAGTTCTGACTCATTGCGAGTCTTGG

CTTTGGGTTAATGGTTCCAGCCATGTTGCTGCTGTGTCTTTTGGTGCAGGAGAGGCTGGGCAC

AGTTGGTCCCTAAGCCATTATGGATAAGGGATGTGTCTGCTGATATACACACATGGACCTGA

CATCCAGGGAAGGCAGGGTGATTGGACAGAACAGTTCTTCCAGAAGCTGTTGGAACTTGGA

CAAGAGTGGCCCTTGGCTTTCTGTAGTTGGTCATCTGTCCCCTGTTGCAATCAGGGGAAGGC

CACACTTGCCTTCCTTAACCACAGTTAGGATTTTCTTGGGGATTAGACCAGATTCTAGCACCT

GTCCTGAACCTCTCGCCCCGCCCCTACAAAGGCTGCTTGCAAGTGTAGTGCACATACACAGG

GAGCAGGTGGGGCATGGAAGTGGAAGTGGAGCCCCTGCCTTTGGCCCTTGGGGGAGGCACT

GTCTGCTTACCCACGGTTGTTGCCTCATAGGAATCATACAACAGCTTCCTAACTGGTCTCCTT

GCCTTCAGTTGGATTGGGGCACAAATCCCTCCTTGACATATAAACCATGGTTTAAGGCTCCC

TGTGGCCTAAATAAAGATAAAGCTTAAGTATCTTAACAAGCACCTAACCCTTCTCCCCAGCC

TCGGTGATTTGGCTCATCGCTGCCTTCATGTTTCATTCTGGCTTCACTCATTCGGAATTTCTTG

TAGTTCCTTGGCTGTTCTCTTTTCCTTACCGCCTTTACAAATGCTCTCACCATGCATGCTTTTC

TCTGCTCCTACAGATGCCTTCTCTCCCAGCACCGCCTCCAGAGTCTATGTCTGGTCGATTCTG

-continued

TCTGCTGTCTCCAGTCCCCATCTTGTGGCAGTCTCTGCTCAATCATTTGGGGATTTTATATGTT

TTCTGGCCTTTCTTTTGGGGGCCTGTCTTCTCCTTCTAAAAGCAGCCAGTTGACCTAGAAGGA

AGGGATAACTGTAACTCTTGTCTACCAACATAAGATTAGGCCCACCCTTTAAAAGCTGCGTC

TTTGAAAGGGACACCTGCACCCAGCATGCTGGCTTCTCTTCACCAAGCGTGACTTCCTACGC

ATTTCACAGGCCTCCAGAGGTCCCCCTGACTCTCTTCTGCTGTGAGAAACTCTAATCATGTAA

GCCACAGGCTAATTCCCTTGAGCCTTAAATGTTTTTAGTAATTTCCCATTCATCAGAGAAGCA

GGATTTGGGAGGAATTTTGAAGCAAACACTACAGAAGGCAGAGTCTCCAGGTAGGATATCT

AAGAGACATTTGGAATGGTCTGACTGTTCAAGATGGATGGGAAAGCCTCTTCCTGTAATGAT

AGTAGCCAACATTTGTTGTCAGGCAGTGGGGCCCCATTTTTGAGATGGGGTCTCTGTCACCC

AGGTTGGAGTGCGGTGGTGCTGTCATGGCTCACTGCAACCTCAGCCTCCCCGGGCTGGGTCT

TCTTAATTCTGAAAAACCCAGCTTTTAAAGGGTGGACCTAATCTTATGTTGGTAGACAATGTT

GTCTCATTTAATACAATGCACATGCTCTCCCCATAACACAAAAGAGGGAACTGAGGCCTGGA

GGTGTGATGTACCCCAAGTCACATAGCTAATAAATAAAGAAGCCAGCATTCCTGGGATTAA

AAATGCATGTGTCTGTCACTGTGGTGTATTTGGTGCTTGATCAATGTTTACTTGAGCAAATGG

AGGGGCAGAGGTACCGATGAGTGTGCTCAGTGAGGAGGGCAGGAGTGAAGCTGGGCGTCTT

CCCGCCTCTTGTGAGTGGTGGGGCTTGGTGAGCTTGCCAGGGCCTGTCTTTCTTATCAAAGA

AGGTGTGTGCCCCAGTGTTACAGCATTTCACCCAAAGCAGCCTAGAAAATGCTTGACTTTTC

TGTCATTCCGGGGAGGACACTTTCCTCCTCCACTGTTCTGCTGGCCTGGTGTACCCACGGCCC

CTGATAGATGATAGCACCTGCTAAAGTGCACCATGCCCTTCCGTCTCACTGCATCCCACAGA

TGAGGCCAGGCTGGGATGAGGGAGAAAGGGAGGGATATATAGTTCAGGTTATTTTGGAAAA

CTGCCTGACCAATTTTAAGTCTGGGCCGGACACTGGGGCATCTCACCACGTTGAAAGGGCCG

TGGCACCCCGGGCGGTGAAAGGGGCTGGAACCAGGTCTGCTTCTTGGGCTTCTCCTCCAGGG

TGCCATTGCTCATGGGCCTTGGCTGCAGAGGTGCTCATTCGTGGTTCCAAAATTCCAATTCCT

GGGAGAGGAAAAATGCTTAGTTCAGTCTCAGTTAGGCCTCTGCTTAGATCAAACAGCCAAG

GCCAGTAGGCCCAGTCCTATGGTAGAGACATGGCCTCAAAGAGCCCTCTGCTGCAGTTGTTG

GGGAGTGTACCAAGAGAAGGGAGCATTGTCCTGGGCTGGGCAGCCCTGGGGGTCTAGTGCA

TAGATGTAGAAAGGCTCTGTTGGTATACCTCCCTTTGCTTGTTGGAAAGTGCTCAACGGGGC

TGAATTGTGTTTGACAGTGTAAGTCTGGGCTGGGGTGAGGGTTGTTACAAGATTGTCAAGAT

GATTAAATGAAATGCCATTTGAAACACTTATCCATGCCTTGTGTATGGTATCCCCACCAGTG

AATATTCACAGTATATTATAATAATTCCAACAACTTCATAATTTTCATATGCAATTTCTAAAC

TTTGAACTTTTTTTTTTTTTTTTTTTTTTTTTGAGACAGTGTCTCGCTCTGTTGCCCAGGCTGGAG

TGCAGTGGCGCAATCTTGGCTCACTGCAACCTCCACCTCCCGGCTTCAAGTGATTCTCCTGCC

TCAGCCTCCTGAGTAGCTAGGAATCCAGGCGCCCGCCACCACACCCAGCTAATTTTTGTATT

TTTAGTAGAGACGGGCTTTCGCCATGTTGGCCAGGCTGGTCTCAAACTCCTGACCTGAGGTG

ATCCACCGCCTTGGCCTTCCAAAGTGCTAGGATTACATACGTGAGCCACTGTGCCCGGCAAT

TTTTTGTGTTTTTAGTAGAGATGGGGTTTCACCATGTTGGCCAGGCTGGTCTCGAACTCCTGA

CCTCAAGTGATCTGCCCGCCTCAGCCTCCCTAATGCTGGGATTACAGGTGTGAGCCACCACG

CCCAGCCTAAACTTTGAATTTCTTTGAACCCATGACTTACACAGAATTAGCTGAACGCAGAA

TTCCAAATCAACTCAGCCTGTGGGACAGCCAAAAAACACAGTGTGCCTTTGGGCTCCTTCAC

TCACCACGCGGGGTTAGAAAACTTTGTCAGAGGCTTTAAAAAAGGAGCTCTTGTGTGTAAAA

TGTTTCCTTGATTCTCTTTCTGGTGCCTCTCTTTCTCTAAGTGGTTTGCTTCCCCAAGTTCCCC

-continued

ACCTGAGTCTGGGTGGCTGTGGCACATCTGTGCATTCTGTACGCACACAGGCAGCCTTTTGG

AGTGCCAGTTTCCAGGTCTTGGTTTTATTTATTTATTTATTTATTTTTTTGAGATGGGGGTCTC

ACTCTGCCGCCCAGGCTGGAGTGCAGTGGTGCCGTCATGGCTCACTGCAACCTCAACCTCCC

TGGGATCAGTTGAGCCTCCTACCTCAGCCTCCAGAGTACTAGGGACCACCATGCCTGGCAAA

TTTTTGTAATTTTTTGTAGAGGCAGAGTCTCACCATGTTGCTCAGGCTGGTCTCGAGCTCCTA

GACTCAAGTGATCTGCCCACCTTGGCCTCCCAAGTGTTAGGATTACAAGTGTGAGCCACCAT

GCCCAGCCCAGGTCATCTTTTGAGGGCATGGAGAGAAGACTTTGAGCATCCCACTTTTGAGA

TTGTGTACCAGTCGCAAGCCCCTATGACACACTTTTTCCCCAAAGTAGAGGGCTCTGACTAT

GTTGATCCCAAGAGAGATGGGAAAGAGCATTGAATGAGGATTCCAAAGTATTGGGCCTTAG

TTCGTTTCCTCATGTTGGTGTTGTGAAGATTCTGGTTAGGATAACAGCATGTGTGCAGGAGG

CTTTGTGAACTGCTGAGAGTGAGGCGTGGCAATGTCAGTGCTAGGTTTGTCCTTACTAACCT

GGGGCCATGGGAATTGATAAGACCAGATTCCCAACTCTACCCCACAATGTGATCCCTGTGGT

GACCCCTCACAGGGCTCTTTGGTCGAGCTTCCCAGAAGGGATCACCATCTGCCATTGTATGT

TGAACCCCATTCATTCATTCATTCATTCAGCCAACCAGCAACTATTTGTTGAGCTCTTATTGT

GTGAGAAGCAGTCTTCAAGGAACTGGGTGAATAAAAAAAACAAAACATCCTAACCTTCATT

GAGCTTACATTCTTACTGAAAGAAAACAAATAAAACATACATGTAATCCTAGCACTTTGGGA

GGCCAAGGCAGGCGGATCACTTGAGGTCAGGAATTTGAAACCAGCCTGGCCAACGTGAAAC

CCATCTCTACTGAAAATTAAAAAAAAAAAAAAAAAAAAGCCGGGCATGGTGGCACATGCCT

GTAATCCCAGCTACTCGCGAGGCTAAGGCAGGAGAATCGCTTGAATCCTGGAGGCAGAGGT

TGCAGTGAGCCAAGATCATACCATTATACTCCAGCCTCAGTGATGAAGCAAGACTCCATCTC

AAAAATAAAAAATAAAAATAAAAATATGCATTCCCTTTGCACCAGCACACTTGGTGCCTGG

GGACCTCGTGGTTGGCACCCTGAAGCAGGTGTCCCTCTTCTGTCTTGCACACCTTGCTTCTGT

CCTGGTGTGTATGGCATGGCCTTCTGCCCTCCATGGTGAGCACTGTGAGGGCAGAGGTTGAG

TTGGGTTTGCTGTATTTCTCAGGTGCCTAGGTTTGTGCTTGACAGGTAGATGGAAGGCACAC

AATGTGGTCATCAAACCTCAGTCAACCATATAAGGAAGGTAGAAGTGAAAAGTCCCATAGG

TACCCAACTAATGTCACCAGTTTCCTGGATACCTTTCCTGGAGTTTATTTATAGTGTGTATAA

ATAAATGATGTATGTGTTTAAATGCCTTTTTCACCTTTCCTTTTAGAGCTGCCTCTTTTTAACA

GTTCCATTCCATTGTATGGATGTACTATGATTTATTGAACCAGTTCCCTACTGATTATTCTGTT

TTTTGCAGTCTTTTGTTATGATGAACATTCCACAGTGACAATGTTGTTCATAGTCATTCACAC

ACATGCAAGTCCTTCTGCAGGATATATTTCTAGAGGGGAATTGCTGACTCAGAGGTTTTGGT

ACTCTGTGTTGATTGTAGAGTGACGGCAGAAAAGTGAGGCCCAAGAGTTTCCTAGTGACCAT

GTGTAGTGGACAAGTCACCAGTCCCTGTGAGTGTTTGGCCCAAAGGCTTTAAGGCATTTGAT

ATCACTGTTTTTGTTTCTGCACCAGGCGGGAGACACTATATTCAATCGTGCTAAGCTCCTCAA

TGTTGGCTTTCAAGAAGCCTTGAAGGACTATGACTACACCTGCTTTGTGTTTAGTGACGTGG

ACCTCATTCCAATGAATGACCATAATGCGTACAGGTGTTTTTCACAGCCACGGCACATTTCC

GTTGCAATGGATAAGTTTGGATTCAGGTAAGAGATACTCAGTCAGAATCTGTGGTAAACATG

TCTCTCTCATGTGTTGACTAGGAAATGCAGTCCTGGCAGCTCAAGAGTGCCTCTTTAAGCTCT

GGAGCAGAATGCCTCCTCTGAGAAATGGGTGCTTTGTATTAGTTGAGATGGAAAGAAGAGA

CCAGAAATGCCTGTAGTCTCTGCACATCCAGACAAAAACAAATTTTCCCCCCTTTTTTTTTTT

TGTTTGTTTTTTGAGACAGGGTCTGGCTCTGTCACCCAGGCTGGAGTGCAGTGCCGTGATCTT

-continued

GGCTCACCGCAACCTCTGCCTCCCGGGTTCATGCCATCCTGTCACCTCAGCCTCCTGAGTAGC

TGGGACTACAAACACTTGCCACCATGCGCAGCTAATTTTTGTATATTTTGTAGAGATGGGGT

TTTGCTGTATTGCCCAGTCTGGTCTCGAACTCCTGAGCTCAAGCAATCCATCTGCCTTGGCCT

CTCGAAGTGCTGGATTATAGGCATGTGGCACCATGCCTGGCCTAAGAACAGTTTTTAGCATT

TGGGAGGGGCTCTCATCTTTAAGCTCCAAATGATACTGTATTTTCTTGCTTTTTTCTTTCTCTT

GCCCCACAAGTTTTGGAAAGTAAATTGGAATAGTTTTCCCCCACTGAATTATTTAGCTTGTAT

ACCTCAGCAGATGTTCCTTGGCCTGTTTTGTTTTGTTTTTGAGACAGGGTCTTGCTCTGTCACC

CAGGCTGGAGTGCAGTGACACAATCATGGCTCACTGCAGCCTTGACTGCCTGGGCTCAATCC

ATCCTGCAGCCTCAGCCTCCTGAGTAGTTGGGACTACAGGCATGAGCCAGCATGTCCAGCTA

ATTTTTTATTTTTAGTGGAGATGAGGTCTGGCTATGTTGCCCAAGCTGGGCTTGAACTCTTGG

GCTCAAGTGATCCTCTCACCTCAGCCTTCCAAAGCATTGGGATTACAGGTGTGAACCACTGC

TCCCGCCCTTGGCCCTATAAGAAGGAATGTGATTCTGTTTTCCAGCAGGGCACAAACTTCTG

CTTAAATACAAAGCCCAAATTTTTCCACCAAAATGCCCCTAGTGAAGTGGCCAGCCCAGATG

CCCGACTAGCGTATTATCCAAAGCATATTGTCATTGGTGGAAAATGGCCTTATAGTCCATTG

TTTTGTCTTAAAAGTAAATATATAAATAAACTTGTATATTGTTTCCTAATTCCGTGTTTATATT

AACATAAAAGTGTTTTAAATTACCTGTCAGTGGCCAGGTGCAGTGGCTCGTGCCTGTAATCG

CAGCACTTTGGGAGGCCGAGGCGGGCAGATCACCTGAGGTCAGGAGTTCGAGACCAGCCTG

ACCAGCATGGTGAAACCCTGTCTCTACTAAAAATACAAAAATTAGCCAGGTGTGGTGGCAG

GTGCCTGTAATCCCAGCTACTCGGGAAGCTGAGGCAGGAGAATTGCTTGAACCCGGGAGGC

AGAGGTTGCAGTGAGTTGAGATCGCGCCATTGAACTTCAACTTGGGCAACAGAGCAAGACT

CTGTCTCAGAGAAAGAAAAAAAAAAACCTATCAGTTGAATAACAAAACCCTTTCCTTCCTTG

CTTTAAGTGAATCTGAAGATCCAGGAGCTGTGCTGCAGGTACCCTCTATGTTGGGTACCCCT

GGTTTAGGCTGACTAGTACAGTGTGGTTGGCTCATGTAGACAGCAGACCCTTTATTTTAGAT

ACAACTTTTTTTCTTTTTCTTTTATTTTTTTTGAGACAGAGTCTTGCTTGTCACCCAGCCTGGA

GTGCAGTGGCGTGATCATGGCTCACTATAGCCTTAAACTCCCTGGCTCAAGTGATCCTCTCA

CCTCGGCTTTCCTAGTAGCTGGGACCACAGGTGTGGGCCAGCACCCCTGGCTGATTTAAAAA

AAAAAAAATTTTTTTTTTTAGAGATGTCTCACTATGTTACCCAGGCTGGTCTTGAACTCCTGG

GGGCTCAAGCAATCCTCCTGCTTTGACCTCCCAAAGTGCTGGGATGACAGGCATGAACTACT

GCACCTGCTGAGATGCAACAGCTTTCTGTCAGACTCATTTTATTCTCATCATTTCTTCCTGTCC

TCCCTTGCTGGGAGCATGAGAGCTGTGATGGGAATATAGGAATGTATGAAGTCCTTCTCCCA

GATCAAAAATCCTAACTTCTTGTCTTAAAGGGAGGAAAATTTGAATGTAACCTTACTTTTAG

ACTCTTCAGAAATCCTTCTATACCCTTCCGTCCCCGCTTTCACCCTTCCTCCCTCTCCGTGTGT

GTATCTTCTTCTCTTGAAACACACAGGTTTATACCCTGACCCCTCTTGATTCATCCCTTGAAG

CACAGTGGTGAACAAGGAAGGGGCCCGTGATGCCCTAATTCTTTGCCACAGCACCATGTTTG

TTTCACAAGGAGCCTGGCAGGTTTGGGCTTGGGGCAGATAGGGGAGAGAAAGCAGCAGAGA

CAGCAAAACCAAATCATGTCAGCTTGGCATGTACTTCCCTCTGAAATAGCTAAGAATCCATT

TCTGTAAAAGCACTGATTATCAGAAAACCTTATTGGCCTGGCCACCTTTGGTTCAAACCCTC

ACATTAATAATGTGGACAGTAGTATGAGGTGTGCCAAAGGTGGATGACTCAGCACCTAAGT

GATGACACCTAATTACGAATAGGTTCATTAAAGCAGACCCCCTGGGGACCTTTGCTTGAGGA

TCCTTACAGTCAGAATTCCTGAATATATTTGAAAATAATAATTGCATCTTTATTTTCATATGT

TCTGTATGGTTTGGCTGACTTCCCCCTCAAAGTCTGAGTTAGAGTTTTCCTTAATTTATGTGA

-continued

TGGGTTTGGTCTTTTTGGATTCCAGAAAGAGCTGGGTGTGGTTTGGAGCTGCACTCAGAGTC

ACACAAAACCACAGCCTTTAGAGAACCCACAGGAAGGCTTTGGGGCACGTCCTGATTCTTGA

CATTTCTCATCAGTGCTGACTTTGTATCCCTTAGGAGTTCACAATTCATAACCACTGAAATAT

TAAAATACAAAAAGTTTTGGAAGGATGAGAGCCCAGATGCTCTACTACTTGAAAATATGTTA

AAACATAAGTTCATCATTATACATTTTGCTAAATCAGGATAAAGTCTGAAGTTTCAAAGAAG

TTTTATTTTAGCAAATTTTCAGAAACACTGCCTCAACTGTTAGGGCCAGTGTTCTAGTCAGTA

TGCCTTTGGAAGCATGAAAGCTGGATTGGTCGATAGGATGGGTGTGGAAGGGGGGCTGTGA

CTGGGTGGGTACAGAGAGGCTCTGAAACAATCTCAGATTCCAGGAGTTCCTGGATAAGGAC

TTCATGTGCGGGAACAGAGCACAGGAGAAGCAGATTCCTGAGCCACTCAGGAAGAACTGGG

CCTAGGCCTGCTCTTGTCACTGACTGGCTTTCTACATAACCACAGAAACAGCACTGTGTTGTA

GAAAGAGGAAGATCATACTTTTTGATATCTGTGTCTAATTTAAGGTCATCTGAGCCCTGATA

GAAAAGCAAAACAGACAAAACCCTTGTAACTGCTCCCTCCCACCCCACCCACCATCAAAAA

AGCTTTAGAGAGGCTGGACATGGTGGCTCTTGCCTGTGATCCCAGCACTTTGGGAGGCTAAG

GTGGGTGGATCACCTGAGGTCAGGAGTTCGAGACCAGCCTGACCAATATGGTGAAACCCCA

TCTGTACTAAAAATACAAAAATTAGCCAGGTGTGGTGGCACACGCCTGTAGTCCCAGCTACT

TGGGAGGCTGAGACAGGAGAATTACTTGAAAACCTGGGAGGCGGAGGTTGCAGTGAGCCGA

GATCACGCCATTGTACTCCAGCCTGGGCTACAGAGCGAGACTCCTTCAAAAAAAAAAAAAA

AAAAAGATCCGGTTTGGTGTCTTACAACTGTAATCCCAGCACTTTGGGAGGCCGAGGCCGGT

GGATCACGAGGTTAAGAGATCAAGACCATCCTGACCAACATGGTGAAACCCTGTCTCTACTA

AAAATTAGCTGGGCGTGGTGGCAGGCGCCTGTAGTCCCAGCTCCTCAGGAGGCTGAGGCAG

AAGAATCGCTTGAACCCGGGAGGCGGAAGTTGCAGTGAGCCTAGATCGCGCCCCTGCACTC

CAGCCTGGCAACAGAGCAAGACTACGTCTCAAAAAAAAAATAAATAAAAACTCTAGAGAAG

CAAAAAGAATAACTTTAAAAGTGTTTATGTTCTCAGCAAGCTTTATTTTGGGGATGTCAGAA

CTTAACTAACCACTGCTCCTTCTGTGTGTATGTTTTTCCTCCAGCCTACCTTATGTTCAGTATT

TTGGAGGTGTCTCTGCTCTAAGTAAACAACAGTTTCTAACCATCAATGGATTTCCTAATAATT

ATTGGGGCTGGGGAGGAGAAGATGATGACATTTTTAACAGGTAATGGTCATAACTTAGATAT

CTTTCTCCTCTGTCAACCTTCACTTCCAGTTTTTTAACCAATGCTTGGTTGTTCCCCAAGGACT

GACCCTCAGATGGGATGCACCCCTAGTCAGCCCACATTCTTAGGTGTGGCTTCCTACAGGTC

CTGCAGGTGCTAAAAGGGATCTGTAGGAAAATGAGTTTCTGAGATTTTTGTATTGGCCTGGA

AAAATGTCAAATGGGAACCAAGTGACGGGGCAAGTTTACTTTGACTTGCTGCATGCCGTTTT

GTACTCAAGGAGTAAACCAATGTCCTTTGTAAAAATCCCTCCTTTCATTATGGTCCCCTTTCA

CTGTGAAACAAGTTTCCTTGAGCAGAATCCTAACTGTCTTCACAGAAGCTTTGTGTTATATTT

TTATTTTGGAGTATTTTCACATATACAAAAGAGATACTGTAGTATAATAAACCTTTGAGGAC

CTATCCAGCCCCAGCAACCATTATGGCCTGGTCAGTTCTGTCCCATCCACATCCTGGGGCTCT

TTTTAAGCTGGTAAATCATTATGATGTGGGTTGTCATTTACAGTGGTAAAAAACATCTATCA

GTAGCATTTGAAAGAACATTCTGCTCAGTCCTCTGGCTGTAGAGGCTTCAACCCCACCAGCC

ACCGATGAGCACCTTCTCCCTCCAGGAGCCAGTCTGAGCTCATTACTGAGTTTAATATCAGA

ATACACCCTGGTGCAGCCTTTCTAAATTGCAGTACCAGTTAACAGAAGGTGTCTGTCAGAGC

AACACCCAAGTCATTCAAGTTACCATTGTGTGCAAACTTAACAGAGACCCACGTCTTCAATA

TAAGCCTTGAAGGAAACTCCAGTTTTAGTATGTAGATGGGGTATCAAGTGTGTGCACATTGA

-continued

ACATCTGCTGCATACAGAGCACTGTGCCAGGCAGGCCCAGGACACTGAAAACCTGGACATA

GGGTCCAGACAGAAGCAAGCCTGCTTCCACAGAGGCACTCCTGGGCAGACACTCTGGACTG

ATATGACAGTGTGCAGGGCCGACAGGATACCACAGGTCTGAATGGTCAGAACAGCTGGGGA

GGGAGGGAGCATCCGCAGGCATCTAGTCCCATGCTAACGCAGTGGCACTAGAAGGATGGGT

GGTGTGTGGAGCAACTTTCTTGAAAGATAAAGGACCTAACACTTTCTATGCACCACTTACTG

TGTGCCAGGCAAGGCCAGGAATGTTTAAGTGGTCTGGGATCAGCCAGTTCTGCCTCTTAACT

AACTTTGCTGTCCTGCTCTCCAGGCTTTCATTTTGGTCCTCATTCCTTTTCCTTGGACCAACAC

AGAATCCTCCACCCTGTTCTGGCTGCCTCTAGTCTTGTTCTCAGCCCTCCATTTGTTTTTTTCT

GCCTTTTCCCACATGTTCTGAAGCCCTCCATTCGTATACTACTTTCCAGAGACTTCCCCATGG

CTAAAAGCATTTTGGAAATACTGTATATTAGGCCCCTTTCAGATACTGGCAACCGTTTGTGG

GATGCTCTGAGAAGGCCTCTGTGACTTAGCCTGGCCCTTTTCAGCCCATCACCTGCCACGTCC

TACCCCAGACCCTTGTCACCAGTCCCCAGGAGCTTACGTTGCTCCCTGAGGGCACTAGGCTT

GCTCTCACTTCCATGCCTTTGCCTGTGCCATCCTGGCTGCCCAAAATGCTATGGCAGATACCT

GTTCATCCTCAACTGGGCTCTGCCTAGGCTTGCTCCAGCAGAGGTTACAAACTCTATGCTTCT

TCCTCTGTGTCTCCAACCTCATCTTCCTCTTCTCACCTCCATCCTGGCCCTAAAGGCCCTATGT

TTGAAGCATTCACACTGTATATTCTGTGGGGCACACGGCCCCAGTGTCTGGCACATGGTAGT

CAACACCACAAACCGCAGAACCAGTTGTAAAAGGACATGGAGTCGGAATGTGAGTTTTAAC

CAGGGTCATGCTGGGCTGGGTTCTGGCATGATGCTGGGTTGTGGGCTGAGTGAGAACAGCA

AGGGTGATGGTGGATGGAGCAACAGTCTTGCAGCCGGGGCTCTCAGGCCAAGTGTATGGCA

GCTCTGTGATAATGACTTTCCCTTTACTCTTTGCAGATTAGTTTTTAGAGGCATGTCTATATCT

CGCCCAAATGCTGTGGTCGGGAGGTGTCGCATGATCCGCCACTCAAGAGACAAGAAAAATG

AACCCAATCCTCAGAGGTGCATTCTTTGTTTATTCATACTCCTTCCCCCTTTAGGATGAGGTA

GGCTGCAGGTCCGAGGCTCTGGGCCTAGAGGGAAATTGAGGTGGTCAGGTTACAGTGGAGA

GGGAGGAGGAAGTACGTGTGATGATTTCTTCTTAAGATTTTTGTTTTAAGACAATCTCCTTGT

GCTCTTTTCCTTGTAGGTTTGACCGAATTGCACACACAAAGGAGACAATGCTCTCTGATGGTT

TGAACTCACTCACCTACCAGGTGCTGGATGTACAGAGATACCCATTGTATACCCAAATCACA

GTGGACATCGGGACACCGAGCTAGCGTTTTGGTACACGGATAAGAGACCTGAAATTAGCCA

GGGACCTCTGCTGTGTGTCTCTGCCAATCTGCTGGGCTGGTCCCTCTCATTTTTACCAGTCTG

AGTGACAGGTCCCCTTCGCTCATCATTCAGATGGCTTTCCAGATGACCAGGACGAGTGGGAT

ATTTTGCCCCCAACTTGGCTCGGCATGTGAATTCTTAGCTCTGCAAGGTGTTTATGCCTTTGC

GGGTTTCTTGATGTGTTCGCAGTGTCACCCCAGAGTCAGAACTGTACACATCCCAAAATTTG

GTGGCCGTGGAACACATTCCCGGTGATAGAATTGCTAAATTGTCGTGAAATAGGTTAGAATT

TTTCTTTAAATTATGGTTTTCTTATTCGTGAAAATTCGGAGAGTGCTGCTAAAATTGGATTGG

TGTGATCTTTTTGGTAGTTGTAATTTAACAGAAAAACACAAAATTTCAACCATTCTTAATGTT

ACGTCCTCCCCCCACCCCCTTCTTTCAGTGGTATGCAACCACTGCAATCACTGTGCATATGTC

TTTTCTTAGCAAAAGGATTTTAAAACTTGAGCCCTGGACCTTTTGTCCTATGTGTGTGGATTC

CAGGGCAACTCTAGCATCAGAGCAAAAGCCTTGGGTTTCTCGCATTCAGTGGCCTATCTCCA

GATTGTCTGATTTCTGAATGTAAAGTTGTTGTGTTTTTTTTTAAATAGTAGTTTGTAGTATTTT

AAAGAAAGAACAGATCGAGTTCTAATTATGATCTAGCTTGATTTTGTGTTGATCCAAATTTG

CATAGCTGTTTAATGTTAAGTCATGACAATTTATTTTTCTTGGCATGCTATGTAAACTTGAAT

TTCCTATGTATTTTTATTGTGGTGTTTTAAATATGGGGAGGGGTATTGAGCATTTTTTAGGGA

-continued

GAAAAATAAATATATGCTGTAGTGGCCACAAATAGGCCTATGATTTAGCTGGCAGGCCAGG

TTTTCTCAAGAGCAAAATCACCCTCTGGCCCCTTGGCAGGTAAGGCCTCCCGGTCAGCATTA

TCCTGCCAGACCTCGGGGAGGATACCTGGGAGACAGAAGCCTCTGCACCTACTGTGCAGAA

CTCTCCACTTCCCCAACCCTCCCCAGGTGGGCAGGGCGGAGGGAGCCTCAGCCTCCTTAGAC

TGACCCCTCAGGCCCCTAGGCTGGGGGGTTGTAAATAACAGCAGTCAGGTTGTTTACCAGCC

CTTTGCACCTCCCCAGGCAGAGGGAGCCTCTGTTCTGGTGGGGGCCACCTCCCTCAGAGGCT

CTGCTAGCCACACTCCGTGGCCCACCCTTTGTTACCAGTTCTTCCTCCTTCCTCTTTTCCCCTG

CCTTTCTCATTCCTTCCTTCGTCTCCCTTTTTGTTCCTTTGCCTCTTGCCTGTCCCCTAAAACTT

GACTGTGGCACTCAGGGTCAAACAGACTATCCATTCCCCAGCATGAATGTGCCTTTTAATTA

GTGATCTAGAAAGAAGTTCAGCCGAACCCACACCCCAACTCCCTCCCAAGAACTTCGGTGCC

TAAAGCCTCCTGTTCCACCTCAGGTTTTCACAGGTGCTCCCACCCCAGTTGAGGCTCCCACCC

ACAGGGCTGTCTGTCACAAACCCACCTCTGTTGGGAGCTATTGAGCCACCTGGGATGAGATG

ACACAAGGCACTCCTACCACTGAGCGCCTTTGCCAGGTCCAGCCTGGGCTCAGGTTCCAAGA

CTCAGCTGCCTAATCCCAGGGTTGAGCCTTGTGCTCGTGGCGGACCCCAAACCACTGCCCTC

CTGGGTACCAGCCCTCAGTGTGGAGGCTGAGCTGGTGCCTGGCCCCAGTCTTATCTGTGCCT

TTACTGCTTTGCGCATCTCAGATGCTAACTTGGTTCTTTTTCCAGAAGCCTTTGTATTGGTTAA

AAATTATTTTCCATTGCAGAAGCAGCTGGACTATGCAAAAAGTATTTCTCTGTCAGTTCCCCA

CTCTATACCAAGGATATTATTAAAACTAGAAATGACTGCATTGAGAGGGAGTTGTGGGAAAT

AAGAAGAATGAAAGCCTCTCTTTCTGTCCGCAGATCCTGACTTTTCCAAAGTGCCTTAAAAG

AAATCAGACAAATGCCCTGAGTGGTAACTTCTGTGTTATTTTACTCTTAAAACCAAACTCTAC

CTTTTCTTGTTGTTTTTTTTTTTTTTTTTTTTTTTTTTTTGGTTACCTTCTCATTCATGTCAAGTA

TGTGGTTCATTCTTAGAACCAAGGGAAATACTGCTCCCCCCATTTGCTGACGTAGTGCTCTCA

TGGGCTCACCTGGGCCCAAGGCACAGCCAGGGCACAGTTAGGCCTGGATGTTTGCCTGGTCC

GTGAGATGCCGCGGGTCCTGTTTCCTTACTGGGGATTTCAGGGCTGGGGGTTCAGGGAGCAT

TTCCTTTTCCTGGGAGTTATGACCGCGAAGTTGTCATGTGCCGTGCCCTTTTCTGTTTCTGTGT

ATCCTATTGCTGGTGACTCTGTGTGAACTGGCCTTTGGGAAAGATCAGAGAGGGCAGAGGTG

GCACAGGACAGTAAAGGAGATGCTGTGCTGGCCTTCAGCCTGGACAGGGTCTCTGCTGACTG

CCAGGGGCGGGGGCTCTGCATAGCCAGGATGACGGCTTTCATGTCCCAGAGACCTGTTGTGC

TGTGTATTTTGATTTCCTGTGTATGCAAATGTGTGTATTTACCATTGTGTAGGGGGCTGTGTC

TGATCTTGGTGTTCAAAACAGAACTGTATTTTTGCCTTTAAAATTAAATAATATAACGTGAAT

AAATGACCCTATCTTTGTAACTGCAGGTGGTTTCTGTTTGCCAGGTGTAAGGGTTGTCATGGC

TGTGGGATGGGGTGGGGACAGGGTCATTCCCTGGTCTGTGACCCATACAAATACACATGCCT

CCCTGGAATCAGACATTTCCCCATCTGAACTTCATTCTCTTATCTGTAAAATGGGAATAATAA

CACATAGGGACTTTTTTGAGGCTTAAAAGTGACGATATATGTAAAACAATGACTAATGCCTC

ACAAGTACTCACTACATAGTAGCTAGTGCCATTTCAAAGTAGAATTTTTTTCCCCTAGCAGTT

CTTGGGCCACATTCTGCTATTTTCAACAGATACCAGGATCATTCAGATGTAGATCTCAGGGC

CATTTGCACCAGGTGCTCACAGTGTAACTTGAAGGGAATTATCCAAAATGAGGTTTCTTGTC

AGTCTCAGGAAATGTAACCATAAGCTCTAAAAGGTCTTAGTTTTTACCCAGGTGCCTCCTCCT

TGGTGGCCCTGGGTCAGGCTGGTTGGATTGAATTGGCACTCCTGAAGAAGGGCTGCAGGAA

ACCAGTGAGCAGGAGAGCCACCCTTGGCAGGGAGCTGCAGGCCCTGCCTGCATGTCACTGC

-continued

TGGAGGGATCCCTGGTGACCTCAGGCCTGTGCAAAGGTGGCCTGGGGTTCAGATCTGGCCTT

CAAACAGGACAACTCTGGTCCTTTGGACAAAATGCTGCCTTAGAGGGTCTGACAAAATTAAA

AACAAACAAAAAAAAACCTGTTTCTTTCCTTCTCACACACCACCACTCACAACACTTCAGTT

CTGCCCCTAGATATGTAGGGATTTCTCCCCACCAACAAGCAGTTTTCTAGTGGACACTAGCT

GGGTGTCCTACAGTTTAACTCAATTCTGACACTGTCTGCCTGGAGATAGCAACGGATCCCAC

AGGTTGAGGGCTCAGTCTCACAAGACTGCCTCCACTGCAGATGCCAGTCACAAGTAGTTGGT

TGTGACCTATGCTTTACAAAAATGTTTTTTGGATACAGGGCCTTGCTGTGTCACCCAGGCTGG

CCTGAAACTCCTGGGCTCACACAATCCTCCCGCCACAACTTAGAAGTAGCTGAGCTGCAGGT

TTATACCACTCACCCAGCTATAGTTGTGACCTATACTTCTGACCAACCAGCTATAAATTGGG

GTTTCTATGAGCCTCTTCTTGGGTTTAATTTGCTAGGTCAGCTTACAGAACTCAGTGTAACAC

TTAACATTTACTGGTCTTATTATAAGTGATATTAGAAAGGATACTGATGAAGAACCGGATGG

AGAGATGCATAGGGCAAGGCATGGGGGAGGGGGAGAGAAGCTTCCATGCCCTCTCCAGGGG

CTCCACCCTCCAGACACCTCCACGTGTTCAGCTATCTGGAAGCTCATCTGACCCTGTCCTTCT

GGTTTTTATGGAAGCTTCATCACATAGGCCTGATAGACTACATCATCGGCCATTGCCAGTCA

GCTCAACCTTCAGCCCTTTTCCCCTTCCTGAAGGATGGGAGTGGGACTGAAAGTGCCAACCT

TCTCATCATGGCTTGGTCTTTCTGGTGACCAGTCCCCATCCAGGAGTTCACTGAGAATCATTT

CATTAAAACAAAAGACGTTCCTATCACCCGGGAAATTCCAAGGGATTAGAAGCTCTGTCAG

GAACCAGGGTCAAGCACCAAATATTAGAACAAAAGATTCTCCTAGCATAAATATTAGAACA

AAAGATTCTCCTAGCATAAATATTAGAACAAAAAATTCTCCTATTGCTCAGGAAATTATAAG

AGTTTTAGGGGCTCTGTACCAGGAACCCAGCGCAGAGGCCAAATATATATATTTTATTATCT

CACAGTGCCACACAGGACTTTGCAAGCTGTCAGGTCTGAGTGAGATGGAGCACACCAGTGA

AAGGTTAAGTTCACCCTTTCACTGATGTGCTCCACTTCACTGAGACACATATCCACACAGAC

ACACAGAGACACACACATCCACCCAGACGCACGCA

In particular, in the present invention, a large GWAS meta-analysis (Mahajan et al., Nature Genetics, 2018, 50, p 1505-1513) of 898,930 human individuals of which 9% were diabetic was assessed, and post-translational glycosylation was surprisingly found to be significantly associated with type 2 diabetes risk in both normal and obese individuals. Importantly, the link between type 2 diabetes and post-translational glycosylation was not identifiable by standard 'functional enrichment' approaches and was thus not identified by the original authors of the meta-analysis.

The computational prediction was confirmed in in vivo mouse studies (Example 9). In these studies, mice were treated with siRNAs that inhibit the expression of B4GALT1. In these mice, plasma levels of LDL cholesterol, fasting glucose, and fibrinogen were significantly lower than in untreated mice, suggesting that inhibition of B4GALT1 can result in the prevention and/or treatment of diabetes, in particular type 2 diabetes.

Therefore, the invention relates to inhibitors of targets within the post translational glycosylation pathways, such as enzymes involved in these pathways, such as B4GALT1. The inhibition may be of the gene or protein resulting from expression of the gene and reference to a gene, such as B4GALT1, hereby explicitly incorporates a reference to inhibition of the expression or function of the gene and, separately, of the protein product.

Post translational glycosylation preferably refers to the post translational glycosylation seen in vivo in a human or human cell.

Definitions

The "first strand", also called the antisense strand or guide strand herein and which can be used interchangeably herein, refers to the nucleic acid strand, e.g. the strand of an siRNA, e.g. a dsiRNA, which includes a region that is substantially complementary to a target sequence, e.g. to an mRNA. As used herein, the term "region of complementarity" refers to the region on the antisense strand that is substantially complementary to a sequence, for example a target sequence. Where the region of complementarity is not fully complementary to the target sequence, the mismatches can be in the internal or terminal regions of the molecule. In some embodiments, a double stranded nucleic acid e.g. an siRNA agent of the invention includes a nucleotide mismatch in the antisense strand.

The "second strand" (also called the sense strand or passenger strand herein, and which can be used interchangeably herein), refers to the strand of a nucleic acid e.g. siRNA that includes a region that is substantially complementary to a region of the antisense strand as that term is defined herein.

In the context of molecule comprising a nucleic acid provided with a ligand moiety, optionally also with a linker moiety, the nucleic acid of the invention may be referred to as an oligonucleotide moiety or oligonucleoside moiety.

Oligonucleotides are short nucleic acid polymers. Whilst oligonucleotides contain phosphodiester bonds between the nucleoside component thereof (base plus sugar), the present invention is not limited to oligonucleotides always joined by such a phosphodiester bond between adjacent nucleosides, and other oligomers of nucleosides joined by bonds which are bonds other than a phosphate bond are contemplated. For example, a bond between nucleotides may be a phosphorothioate bond. Therefore, the term "oligonucleoside" herein covers both oligonucleotides and other oligomers of nucleosides. An oligonucleoside which is a nucleic acid having at least a portion which is an oligonucleotide is preferred according to the present invention. An oligonucleoside having one or more, or a majority of, phosphodiester backbone bonds between nucleosides is also preferred according to the present invention. An oligonucleoside having one or more, or a majority of, phosphodiester backbone bonds between nucleosides, and also having one or more phosphorothioate backbone bonds between nucleosides (typically in a terminal region of the first and/or second strands) is also preferred according to the present invention.

In some embodiments, a double stranded nucleic acid, e.g., siRNA agent of the invention includes a nucleoside mismatch in the sense strand. In some embodiments, the nucleoside mismatch is, for example, within 5, 4, 3, 2, or 1 nucleosides from the 3'-end of the nucleic acid e.g. siRNA.

In another embodiment, the nucleoside mismatch is, for example, in the 3'-terminal nucleoside of the nucleic acid, e.g., siRNA.

A "target sequence" (which may be called a target RNA or a target mRNA) refers to a contiguous portion of the nucleoside sequence of an mRNA molecule formed during the transcription of a gene, including mRNA that is a product of RNA processing of a primary transcription product, or can be a contiguous portion of the nucleotide sequence of any RNA molecule such as a LNCRNA which it is desired to inhibit.

The target sequence may be from about 10-35 nucleosides in length, e.g., about 15-30 nucleosides in length. For example, the target sequence can be from about 15-30 nucleosides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleosides in length. Ranges and lengths intermediate to the above recited ranges and lengths are also contemplated to be part of the invention.

The term "ribonucleoside" or "nucleoside" can also refer to a modified nucleoside as further detailed below.

A nucleic acid can be a DNA or an RNA, and can comprise modified nucleosides, RNA is a preferred nucleic acid.

The terms "iRNA", "siRNA", "RNAi agent," and "iRNA agent," "RNA interference agent" as used interchangeably herein, refer to an agent that contains RNA, and which mediates the targeted cleavage of an RNA transcript via an RNA-induced silencing complex (RISC) pathway. siRNA directs the sequence-specific degradation of mRNA through RNA interference (RNAi).

A double stranded RNA is referred to herein as a "double stranded siRNA (dsiRNA) agent", "double stranded siRNA (dsiRNA) molecule", "double stranded RNA (dsRNA) agent", "double stranded RNA (dsRNA) molecule", "dsiRNA agent", "dsiRNA molecule", or "dsiRNA", which refers to a complex of ribonucleic acid molecules, having a duplex structure comprising two anti-parallel and substantially complementary nucleic acid strands, referred to as having "sense" and "antisense" orientations with respect to a target RNA. The majority of nucleosides of each strand of the nucleic acid, e.g. a dsiRNA molecule, are preferably ribonucleosides, but in that case each or both strands can also include one or more non-ribonucleosides, e.g., a deoxyribonucleoside or a modified ribonucleoside. In addition, as used in this specification, an "siRNA" may include ribonucleosides with chemical modifications.

The term "modified nucleoside" refers to a nucleoside having, independently, a modified sugar moiety, a modified internucleoside linkage, or modified nucleobase, or any combination thereof. Thus, the term modified nucleoside encompasses substitutions, additions or removal of, e.g., a functional group or atom, to internucleoside linkages, sugar moieties, or nucleobases. Any such modifications, as used in a siRNA type molecule, are encompassed by "iRNA" or "RNAi agent" or "siRNA" or "siRNA agent" for the purposes of this specification and claims.

The duplex region of a nucleic acid of the invention e.g. a dsRNA may range from about 9 to 40 base pairs in length such as 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 base pairs in length.

The two strands forming the duplex structure may be different portions of one larger molecule, or they may be separate molecules e.g. RNA molecules.

The term "nucleoside overhang" refers to at least one unpaired nucleoside that extends from the duplex structure of a double stranded nucleic acid. A ds nucleic acid can comprise an overhang of at least one nucleoside; alternatively the overhang can comprise at least two nucleosides, at least three nucleosides, at least four nucleosides, at least five nucleosides, or more. A nucleoside overhang can comprise or consist of a nucleoside analog, including a deoxynucleoside. The overhang(s) can be on the sense strand, the antisense strand, or any combination thereof. Furthermore, the/nucleoside(s) of an overhang can be present on the 5'-end, 3'-end, or both ends of either an antisense or sense strand.

In certain embodiments, the antisense strand has a 1-10 nucleoside, e.g., 0-3, 1-3, 2-4, 2-5, 4-10, 5-10, 1, 2, 3, 4, 5, 6, 7, 8, 9, or 10 nucleoside overhang at the 3'-end or the 5'-end.

"Blunt" or "blunt end" means that there are no unpaired nucleoside at that end of the double stranded nucleic acid, i.e., no nucleoside overhang. The nucleic acids of the invention include those with no nucleoside overhang at one end or with no nucleoside overhangs at either end.

Unless otherwise indicated, the term "complementary," when used to describe a first nucleoside sequence in relation to a second nucleoside sequence, refers to the ability of an oligonucleoside comprising the first nucleoside sequence to hybridize and form a duplex structure under certain conditions with an oligonucleoside or polynucleoside comprising the second nucleoside sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press).

Complementary sequences within nucleic acid e.g. a dsiRNA, as described herein, include base-pairing of the oligonucleoside or polynucleoside comprising a first nucleoside sequence to an oligonucleoside or polynucleoside comprising a second nucleoside sequence over the entire length of one or both nucleoside sequences. Such sequences can be referred to as "fully complementary" with respect to each other herein. However, where a first sequence is referred to as "substantially complementary" or "partially complementary" with respect to a second sequence herein, the two sequences can be fully complementary, or they can form one or more mismatched base pairs, such as 2, 4, or 5 mismatched base pairs, but preferably not more than 5, while retaining the ability to hybridize under the conditions most relevant to their ultimate application, e.g., inhibition of gene expression via a RISC pathway. Overhangs shall not be regarded as mismatches with regard to the determination of complementarity. For example, a nucleic acid e.g. dsRNA comprising one oligonucleoside 17 nucleosides in length and another oligonucleoside 19 nucleosides in length, wherein the longer oligonucleoside comprises a sequence of 17 nucleosides that is fully complementary to the shorter oligonucleoside, can yet be referred to as "fully complementary".

"Complementary" sequences, as used herein, can also include, or be formed entirely from, non-Watson-Crick base pairs or base pairs formed from non-natural and modified nucleosides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially/partially complementary" herein can be used with respect to the base matching between the sense strand and the antisense strand of a nucleic acid e.g. dsiRNA, or between the antisense strand of a double stranded nucleic acid e.g. siRNA agent and a target sequence.

Within the present invention, the second strand of the nucleic acid according to the invention, in particular a dsiRNA for inhibiting B4GALT1, is at least partially complementary to the first strand of said nucleic acid. In certain embodiments, a first and second strand of a nucleic acid according to the invention are partially complementary if they form a duplex region having a length of at least 17 base pairs and comprising not more than 1, 2, 3, 4, or 5 mismatched base pairs.

In certain embodiments, a first and second strand of the nucleic acid according to the invention are partially complementary if they form a duplex region having a length of 19 base pairs and comprising not more than 1, 2, 3, 4, or 5 mismatched base pairs. In certain embodiments, a first and second strand of the nucleic acid according to the invention are partially complementary if they form a duplex region having a length of 21 base pairs comprising not more than 1, 2, 3, 4, or 5 mismatched base pairs.

Alternatively, a first and second strand of the nucleic acid according to the invention are partially complementary if they form a duplex region having a length of at least 17 base pairs, wherein at least 14, 15, 16 or 17 of said base pairs are complementary base pairs, in particular Watson-Crick base pairs.

[In certain embodiments, a first and second strand of the nucleic acid according to the invention are partially complementary if they form a duplex region having a length of 19 base pairs, wherein at least 14, 15, 16, 17, 18 or all 19 base pairs are complementary base pairs, in particular Watson-Crick base pairs. In certain embodiments, a first and second strand of the nucleic acid according to the invention are partially complementary if they form a duplex region having a length of 21 base pairs, wherein at least 16, 17, 18, 19, 20 or all 21 base pairs are complementary base pairs, in particular Watson-Crick base pairs.

As used herein, a nucleic acid that is "substantially complementary" or "partially complementary" to at least part of a messenger RNA (mRNA) refers to a polynucleoside that is substantially or partially complementary to a contiguous portion of the mRNA of interest (e.g., an mRNA encoding a gene). In certain embodiments, the contiguous portion of the mRNA is a sequence as listed in Table 1, i.e., any one of SEQ ID NOs: 2-21 or 102-201. For example, a polynucleoside is complementary to at least a part of an mRNA of a gene of interest if the sequence is substantially or partially complementary to a non-interrupted portion of an mRNA encoding that gene.

Accordingly, in some preferred embodiments, the antisense oligonucleosides as disclosed herein are fully complementary to the target gene sequence.

In other embodiments, the antisense oligonucleosides disclosed herein are substantially or partially complementary to a target RNA sequence and comprise a contiguous nucleoside sequence which is at least about 80% complementary over its entire length to the equivalent region of the target RNA sequence, such as at least about 85%, 86%, 87%, 88%, 89%, about 90%, 91%, 92%, 93%, 94%, 95%, 96%, 97%, 98%, or 99% complementary or 100% complementary.

In certain embodiments, the first (antisense) strand of a nucleic acid according to the invention is partially or fully complementary to a contiguous portion of RNA transcribed from the B4GALT1 gene. In certain embodiments, the first strand of the nucleic acid according to the invention is partially or fully complementary to a contiguous portion of at least 17 nucleosides of the B4GALT1 mRNA. In certain embodiments, the first strand of the nucleic acid according to the invention is partially or fully complementary to a contiguous portion of 17, 18, 19, 20, 21, 22 or 23 nucleosides of the B4GALT1 mRNA. In certain embodiments, the first strand of the nucleic acid according to the invention is partially or fully complementary to a contiguous portion of 17, 18 or 19 nucleosides of any one of the sequences as listed in Table 1, i.e., any one of SEQ ID NOs: 2-21 or 102-201. In certain embodiments, the first strand of the nucleic acid according to the invention is partially or fully complementary to a contiguous portion of 19, 20, 21, 22 or 23 nucleosides of any one of SEQ ID NOs: 102-201.

In certain embodiments, the first (antisense) strand of the nucleic acid according to the invention is partially complementary to a contiguous portion of the B4GALT1 mRNA if it comprises a contiguous nucleoside sequence of at least 17 nucleosides, wherein at least 14, 15, 16 or 17 nucleosides of said contiguous nucleoside sequence are complementary to a contiguous portion of the B4GALT1 mRNA. In certain embodiments, the first strand of the nucleic acid according to the invention comprises a contiguous nucleoside sequence of at least 17 nucleosides, wherein at least 14, 15, 16 or 17 nucleosides of said contiguous nucleoside sequence are complementary to a contiguous portion of any one of the sequences listed in Table 1, i.e., any one of SEQ ID NOs: 2-21 or 102-201. In certain embodiments, the first strand of the nucleic acid according to the invention comprises a contiguous nucleoside sequence of 19 nucleosides, wherein at least 14, 15, 16, 17, 18 or all 19 nucleosides of said contiguous nucleoside sequence are complementary to a contiguous portion of any one of the sequences listed in Table 1, i.e., any one of SEQ ID NOs: 2-21 or 102-201. In certain embodiments, the first strand of the nucleic acid according to the invention comprises a contiguous nucleoside sequence of 21 nucleosides, wherein at least 16, 17, 18, 19, 20 or all 21 nucleosides of said contiguous nucleoside sequence are complementary to a contiguous portion of any one of SEQ ID NOs: 102-201. In certain embodiments, the first strand of the nucleic acid according to the invention comprises a contiguous nucleoside sequence of 23 nucleosides, wherein at least 18, 19, 20, 21, 22 or all 23 nucleosides of said contiguous nucleoside sequence are complementary to a contiguous portion of any one of SEQ ID NOs: 102-201.

In some embodiments, a nucleic acid e.g. an siRNA of the invention includes a sense strand that is substantially or partially complementary to an antisense polynucleoside which, in turn, is complementary to a target gene sequence and comprises a contiguous nucleoside sequence which is at least about 80% complementary over its entire length to the equivalent region of the nucleoside sequence of the antisense strand, such as about 85%, 86%, 87%, 88%, 89%, 90%, 91%, 92%, 93%, 94%, 95%, 96%, 97%, 98%, or 99% complementary, or 100% complementary.

In some embodiments, a nucleic acid e.g. an siRNA of the invention includes an antisense strand that is substantially or partially complementary to the target sequence and comprises a contiguous nucleoside sequence which is at least 80% complementary over its entire length to the target sequence such as about 85%, 86%, 87%, 88%, 89%, 90%, 91%, 92%, 93%, 94%, 95%, 96%, 97%, 98%, or 99% complementary, or 100% complementary.

As used herein, a "subject" is an animal, such as a mammal, including a primate (such as a human, a non-human primate, e.g., a monkey, and a chimpanzee), or a non-primate or a bird that expresses the target gene, either endogenously or heterologously, when the target gene sequence has sufficient complementarity to the nucleic acid e.g. iRNA agent to promote target knockdown. In certain preferred embodiments, the subject is a human.

The terms "treating" or "treatment" refer to a beneficial or desired result including, but not limited to, alleviation or amelioration of one or more symptoms associated with gene expression. "Treatment" can also mean prolonging survival as compared to expected survival in the absence of treatment. Treatment can include prevention of development of co-morbidities, e.g. reduced liver damage in a subject with a hepatic infection.

"Therapeutically effective amount," as used herein, is intended to include the amount of a nucleic acid e.g. an iRNA that, when administered to a patient for treating a subject having disease, is sufficient to effect treatment of the disease (e.g., by diminishing, ameliorating or maintaining the existing disease or one or more symptoms of disease or its related comorbidities).

The phrase "pharmaceutically acceptable" is employed herein to refer to compounds, materials, compositions, or dosage forms which are suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition, or vehicle, such as a liquid or solid filler, diluent, excipient, manufacturing aid or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated.

Where a value or range of values of a parameter are recited, it is intended that values and ranges intermediate to the recited values are also intended to be part of this invention.

The articles "a" and "an" are used herein to refer to one or to more than one (i.e. to at least one) of the grammatical object of the article.

The term "including" is used herein to mean, and is used interchangeably with, the phrase "including but not limited to".

The term "or" is used herein to mean, and is used interchangeably with, the term "and/or," unless context clearly indicates otherwise. For example, "sense strand or antisense strand" is understood as "sense strand or antisense strand or sense strand and antisense strand."

The term "about" is used herein to mean within the typical ranges of tolerances in the art. For example, "about" can be understood as about 2 standard deviations from the mean. In certain embodiments, about means +10%. In certain embodiments, about means +5%. When about is present before a series of numbers or a range, it is understood that "about" can modify each of the numbers in the series or range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 18 nucleosides of a 21 nucleoside nucleic acid molecule" means that 18, 19, 20, or 21 nucleosides have the indicated property. When at least is present before a series of numbers or a range, it is understood that "at least" can modify each of the numbers in the series or range.

As used herein, "no more than" or "less than" is understood as the value adjacent to the phrase and logical lower values or integers, as logical from context, to zero. For example, a duplex with an overhang of "no more than 2 nucleosides" has a 2, 1, or 0 nucleoside overhang. When "no more than" is present before a series of numbers or a range, it is understood that "no more than" can modify each of the numbers in the series or range.

The terminal region of a strand is the last 5 nucleotides from the 5' or the 3' end. A nucleobase sequence is the sequence of the bases of the nucleic acid in an oligomer.

Various embodiments of the invention can be combined as determined appropriate by one of skill in the art.

Target

A target for inhibition disclosed herein may be, without limitation, an mRNA, LNCRNA, polypeptide, protein, or gene.

The target herein is a target involved in the post translational glycosylation pathway for proteins. These are preferably a target the inhibition of which helps in the prevention or treatment of diabetes. A preferred target for inhibition is 1B4GALT1, and inhibition may be effected by inhibition of expression or function of the gene or protein or both.

In one aspect the target is a mRNA expressed from a gene or a long non-coding RNA (LNCRNA).

In a preferred embodiment, the target is an mRNA that is the result of expression of the 1B4GALT1 gene. Exemplary target sequences on the 1B4GALT1mRNA are listed below in Table 1.

TABLE 1

| SEQ ID NO | Oligonucleoside mRNA target sequence 5'→3' | Starting position on NM_001497.4 |
|---|---|---|
| SEQ ID NO: 2 | CUUGAAUUUCCUAUGUAUU | 2210 |
| SEQ ID NO: 3 | AAUGGAUUUCCUAAUAAUU | 1068 |
| SEQ ID NO: 4 | UCAGUAUUUUGGAGGUGUC | 1016 |
| SEQ ID NO: 5 | UGGAUUUCCUAAUAAUUAU | 1070 |
| SEQ ID NO: 6 | UGAAUUUCCUAUGUAUUUU | 2212 |
| SEQ ID NO: 7 | GCUGGAUGUACAGAGAUAC | 1301 |
| SEQ ID NO: 8 | CCAAAGUGCCUUAAAAGAA | 3448 |
| SEQ ID NO: 9 | UAUGUAAACUUGAAUUUCC | 2202 |
| SEQ ID NO: 10 | GGCACAUUUCCGUUGCAAU | 967 |
| SEQ ID NO: 11 | AUGUAAACUUGAAUUUCCU | 2203 |
| SEQ ID NO: 12 | AUGGAUUUCCUAAUAAUUA | 1069 |
| SEQ ID NO: 13 | UGUCUCUGCUCUAAGUAAA | 1031 |
| SEQ ID NO: 14 | CAAAGUGCCUUAAAAGAAA | 3449 |
| SEQ ID NO: 15 | UGAAUGUGCCUUUUAAUUA | 2822 |
| SEQ ID NO: 16 | ACUUGAAUUUCCUAUGUAU | 2209 |
| SEQ ID NO: 17 | CUGACUUUUCCAAAGUGCC | 3439 |
| SEQ ID NO: 18 | CAAUGGAUUUCCUAAUAAU | 1067 |
| SEQ ID NO: 19 | UUCAGUAUUUUGGAGGUGU | 1015 |
| SEQ ID NO: 20 | CCUGACUUUUCCAAAGUGC | 3438 |
| SEQ ID NO: 21 | GGAUUUCCUAAUAAUUAUU | 1071 |
| SEQ ID NO: 102 | GUAAACUUGAAUUUCCUAUGUAU | 2209 |
| SEQ ID NO: 103 | GCUAUGUAAACUUGAAUUUCCUA | 2204 |
| SEQ ID NO: 104 | UAUGUAAACUUGAAUUUCCUAUG | 2206 |
| SEQ ID NO: 105 | AACUUGAAUUUCCUAUGUAUUUU | 2212 |
| SEQ ID NO: 106 | AAACUUGAAUUUCCUAUGUAUUU | 2211 |
| SEQ ID NO: 107 | CUAUGUAAACUUGAAUUUCCUAU | 2205 |
| SEQ ID NO: 108 | GCAUGCUAUGUAAACUUGAAUUU | 2200 |
| SEQ ID NO: 109 | UGUCUGAUUUCUGAAUGUAAAGU | 2035 |
| SEQ ID NO: 110 | UGUAAACUUGAAUUUCCUAUGUA | 2208 |
| SEQ ID NO: 111 | UCAAUGGAUUUCCUAAUAAUUAU | 1070 |
| SEQ ID NO: 112 | CAAUGGAUUUCCUAAUAAUUAUU | 1071 |
| SEQ ID NO: 113 | GGCAUGCUAUGUAAACUUGAAUU | 2199 |
| SEQ ID NO: 114 | UUUUGGAGGUGUCUCUGCUCUAA | 1026 |
| SEQ ID NO: 115 | AAUCCUCAGAGGUUUGACCGAAU | 1225 |
| SEQ ID NO: 116 | AUCAAUGGAUUUCCUAAUAAUUA | 1069 |

TABLE 1-continued

| SEQ ID NO | Oligonucleoside mRNA target sequence 5'→3' | Starting position on NM_001497.4 |
|---|---|---|
| SEQ ID NO: 117 | GACUUUUCCAAAGUGCCUUAAAA | 3445 |
| SEQ ID NO: 118 | CAUGCUAUGUAAACUUGAAUUUC | 2201 |
| SEQ ID NO: 119 | CCAUCAAUGGAUUUCCUAAUAAU | 1067 |
| SEQ ID NO: 120 | UAAACUUGAAUUUCCUAUGUAUU | 2210 |
| SEQ ID NO: 121 | UCUGCUCUAAGUAAACAACAGUU | 1039 |
| SEQ ID NO: 122 | AUGCUAUGUAAACUUGAAUUUCC | 2202 |
| SEQ ID NO: 123 | GAGGUGUCUCUGCUCUAAGUAAA | 1031 |
| SEQ ID NO: 124 | AGCAUGAAUGUGCCUUUUAAUUA | 2822 |
| SEQ ID NO: 125 | GGAGGUGUCUCUGCUCUAAGUAA | 1030 |
| SEQ ID NO: 126 | UUUCCAAAGUGCCUUAAAAGAAA | 3449 |
| SEQ ID NO: 127 | UGCUAUGUAAACUUGAAUUUCCU | 2203 |
| SEQ ID NO: 128 | UUCAGUAUUUUGGAGGUGUCUCU | 1019 |
| SEQ ID NO: 129 | CCAGCAUGAAUGUGCCUUUUAAU | 2820 |
| SEQ ID NO: 130 | AGGUGUCUCUGCUCUAAGUAAAC | 1032 |
| SEQ ID NO: 131 | GGAGGAGAAGAUGAUGACAUUUU | 1102 |
| SEQ ID NO: 132 | UUGGAGGUGUCUCUGCUCUAAGU | 1028 |
| SEQ ID NO: 133 | UUGUCUGAUUUCUGAAUGUAAAG | 2034 |
| SEQ ID NO: 134 | CCACGGCACAUUUCCGUUGCAAU | 967 |
| SEQ ID NO: 135 | UGGAUUUCCUAAUAAUUAUUGGG | 1074 |
| SEQ ID NO: 136 | UGUUCAGUAUUUUGGAGGUGUCU | 1017 |
| SEQ ID NO: 137 | CAUCAAUGGAUUUCCUAAUAAUU | 1068 |
| SEQ ID NO: 138 | CAAUCCUCAGAGGUUUGACCGAA | 1224 |
| SEQ ID NO: 139 | GAUGGUUUGAACUCACUCACCUA | 1276 |
| SEQ ID NO: 140 | UUUUCCAAAGUGCCUUAAAAGAA | 3448 |
| SEQ ID NO: 141 | ACUUUUCCAAAGUGCCUUAAAAG | 3446 |
| SEQ ID NO: 142 | GGUGUCUCUGCUCUAAGUAAACA | 1033 |
| SEQ ID NO: 143 | AUCCUGACUUUUCCAAAGUGCCU | 3440 |
| SEQ ID NO: 144 | GUAUUUUGGAGGUGUCUCUGCUC | 1023 |
| SEQ ID NO: 145 | AUGGUUUGAACUCACUCACCUAC | 1277 |
| SEQ ID NO: 146 | AUUUUGGAGGUGUCUCUGCUCUA | 1025 |
| SEQ ID NO: 147 | UGUCUCUGCUCUAAGUAAACAAC | 1035 |
| SEQ ID NO: 148 | CGGCACAUUUCCGUUGCAAUGGA | 970 |
| SEQ ID NO: 149 | GCAUGAAUGUGCCUUUUAAUUAG | 2823 |
| SEQ ID NO: 150 | CACGGCACAUUUCCGUUGCAAUG | 968 |
| SEQ ID NO: 151 | UAUACCCAAAUCACAGUGGACAU | 1330 |
| SEQ ID NO: 152 | AUCACAGUGGACAUCGGGACACC | 1339 |
| SEQ ID NO: 153 | GUGUCUCUGCUCUAAGUAAACAA | 1034 |
| SEQ ID NO: 154 | CAGAUCCUGACUUUUCCAAAGUG | 3437 |

TABLE 1-continued

| SEQ ID NO | Oligonucleoside mRNA target sequence 5'→3' | Starting position on NM_001497.4 |
|---|---|---|
| SEQ ID NO: 155 | CAGCAUGAAUGUGCCUUUUAAUU | 2821 |
| SEQ ID NO: 156 | CUUAUGUUCAGUAUUUUGGAGGU | 1013 |
| SEQ ID NO: 157 | AAUGGAUUUCCUAAUAAUUAUUG | 1072 |
| SEQ ID NO: 158 | UGGAGGUGUCUCUGCUCUAAGUA | 1029 |
| SEQ ID NO: 159 | AGGUGCUGGAUGUACAGAGAUAC | 1301 |
| SEQ ID NO: 160 | CUGCUCUAAGUAAACAACAGUUU | 1040 |
| SEQ ID NO: 161 | UCUCUGCUCUAAGUAAACAACAG | 1037 |
| SEQ ID NO: 162 | UAUGUUCAGUAUUUUGGAGGUGU | 1015 |
| SEQ ID NO: 163 | UAUUUUGGAGGUGUCUCUGCUCU | 1024 |
| SEQ ID NO: 164 | ACCCAAAUCACAGUGGACAUCGG | 1333 |
| SEQ ID NO: 165 | CUCUGCUCUAAGUAAACAACAGU | 1038 |
| SEQ ID NO: 166 | UUUGGAGGUGUCUCUGCUCUAAG | 1027 |
| SEQ ID NO: 167 | CUUUUCCAAAGUGCCUUAAAAGA | 3447 |
| SEQ ID NO: 168 | GGUGCUGGAUGUACAGAGAUACC | 1302 |
| SEQ ID NO: 169 | GAUCCUGACUUUUCCAAAGUGCC | 3439 |
| SEQ ID NO: 170 | CUGCGUCUCUCCUCACAAGGUGG | 684 |
| SEQ ID NO: 171 | AUGGAUUUCCUAAUAAUUAUUGG | 1073 |
| SEQ ID NO: 172 | ACGGCACAUUUCCGUUGCAAUGG | 969 |
| SEQ ID NO: 173 | UGUAUACCCAAAUCACAGUGGAC | 1328 |
| SEQ ID NO: 174 | GUUCAGUAUUUUGGAGGUGUCUC | 1018 |
| SEQ ID NO: 175 | GGCUUUCAAGAAGCCUUGAAGGA | 862 |
| SEQ ID NO: 176 | AAUUAUUGGGGCUGGGGAGGAGA | 1087 |
| SEQ ID NO: 177 | GGACAUCGGGACACCGAGCUAGC | 1347 |
| SEQ ID NO: 178 | AGAUCCUGACUUUUCCAAAGUGC | 3438 |
| SEQ ID NO: 179 | GUAUACCCAAAUCACAGUGGACA | 1329 |
| SEQ ID NO: 180 | CCAUUCCGCAACCGGCAGGAGCA | 718 |
| SEQ ID NO: 181 | GUGCUGGAUGUACAGAGAUACCC | 1303 |
| SEQ ID NO: 182 | GACUGCGUCUCUCCUCACAAGGU | 682 |
| SEQ ID NO: 183 | CAAAUCACAGUGGACAUCGGGAC | 1336 |
| SEQ ID NO: 184 | GUCUCUGCUCUAAGUAAACAACA | 1036 |
| SEQ ID NO: 185 | AUGUUCAGUAUUUUGGAGGUGUC | 1016 |
| SEQ ID NO: 186 | AUUAUUGGGGCUGGGGAGGAGAA | 1088 |
| SEQ ID NO: 187 | CCUUAUGUUCAGUAUUUUGGAGG | 1012 |
| SEQ ID NO: 188 | AUACCCAAAUCACAGUGGACAUC | 1331 |
| SEQ ID NO: 189 | GGAUUUCCUAAUAAUUAUUGGGG | 1075 |
| SEQ ID NO: 190 | UCACAGUGGACAUCGGGACACCG | 1340 |
| SEQ ID NO: 191 | UUGUAUACCCAAAUCACAGUGGA | 1327 |
| SEQ ID NO: 192 | AUUGGGGCUGGGGAGGAGAAGAU | 1091 |
| SEQ ID NO: 193 | UUAUGUUCAGUAUUUUGGAGGUG | 1014 |

TABLE 1-continued

| SEQ ID NO | Oligonucleoside mRNA target sequence 5'→3' | Starting position on NM_001497.4 |
|---|---|---|
| SEQ ID NO: 194 | UGGACAUCGGGACACCGAGCUAG | 1346 |
| SEQ ID NO: 195 | ACAGUGGACAUCGGGACACCGAG | 1342 |
| SEQ ID NO: 196 | UAAUUAUUGGGGCUGGGGAGGAG | 1086 |
| SEQ ID NO: 197 | UUGGGGCUGGGGAGGAGAAGAUG | 1092 |
| SEQ ID NO: 198 | GGACUGCGUCUCUCCUCACAAGG | 681 |
| SEQ ID NO: 199 | CUAAUAAUUAUUGGGGCUGGGGA | 1082 |
| SEQ ID NO: 200 | AAUCACAGUGGACAUCGGGACAC | 1338 |
| SEQ ID NO: 201 | ACUGCGUCUCUCCUCACAAGGUG | 683 |

It is to be understood that SEQ ID NOs: 2-21 and SEQ ID NOs: 102-201 relate to human (*Homo sapiens*) mRNA sequences.

Disease/Conditions

The invention relates to an inhibitor suitable for use, or for use, in treatment of diabetes, such as type 1 or type 2 diabetes, preferably type 2 diabetes.

Inhibitors

Inhibitors of the invention include nucleic acids such as siRNAs, antibodies and antigen binding fragments thereof, e.g., monoclonal antibodies, polypeptides, antibody-drug conjugates, and small molecules. Preferred are nucleic acids such as siRNA.

Certain preferred features of inhibitors of the invention, where these are oligonucelosides such as siRNA, are given below.

In certain embodiments, the nucleic acid comprises a first strand comprising a sequence that is at least partially complementary to a portion of RNA transcribed from the B4GALT1 gene (SEQ ID NO:1). In a preferred embodiment, the nucleic acid comprises a first strand comprising a sequence that is at least partially complementary to a B4GALT1 mRNA (NM_001497.4).

In certain embodiments, the nucleic acid for inhibiting expression of B4GALT1 comprises a duplex region that comprises a first strand and a second strand that is at least partially complementary to the first strand, wherein said first strand is:

(i) at least partially complementary to a portion of RNA transcribed from the B4GALT1 gene, and (ii) comprises at least 17 contiguous nucleosides differing by 0 or 1 nucleosides from any one of SEQ ID NOs: 22-41 or SEQ ID NOs: 202-301.

In certain embodiments, the first strand comprises nucleosides 2-18 of any one of the sequences set forth in SEQ ID NOs: 22-41 or SEQ ID NOs: 202-301.

In certain embodiments, the nucleic acid for inhibiting expression of B4GALT1 comprises a duplex region that comprises a first strand and a second strand that is at least partially complementary to the first strand, wherein said first strand is:

(i) at least partially complementary to a portion of RNA transcribed from the B4GALT1 gene, and (ii) comprises at least 21 contiguous nucleosides differing by 0 or 1 nucleosides from any one of SEQ ID NOs: 202-301.

In certain embodiments, the first strand comprises nucleosides 2-22 of any one of the sequences set forth in SEQ ID NOs: 202-301.

In certain embodiments, the first strand comprises any one of SEQ ID NOs: 22-41 or SEQ ID NOs: 202-301.

In certain embodiments, the second strand comprises a nucleoside sequence of at least 17 contiguous nucleosides differing by 0 or 1 nucleosides from any one of SEQ ID NOs: 42-61 or SEQ ID NOs: 302-401; wherein the second strand has a region of at least 85% complementarity over the 17 contiguous nucleosides to the first strand.

In certain embodiments, the second strand comprises a nucleoside sequence of at least 19 contiguous nucleosides differing by 0 or 1 nucleosides from any one of SEQ ID NOs: 302-401; wherein the second strand has a region of at least 85% complementarity over the 19 contiguous nucleosides to the first strand.

In certain embodiments, the second strand comprises a nucleoside sequence of at least 21 contiguous nucleosides differing by 0 or 1 nucleosides from any one of SEQ ID NOs: 302-401; wherein the second strand has a region of at least 85% complementarity over the 21 contiguous nucleosides to the first strand.

In certain embodiments, the second strand comprises any one of SEQ ID NOs: 42-61 or SEQ ID NOs: 302-401.

In certain embodiments, the nucleic acid comprises a first strand that comprises, consists of, or consists essentially of a nucleoside sequence differing by 0 or 1 nucleosides from any one of SEQ ID NOs: 22-41 or SEQ ID NOs: 202-301;

And a second strand that comprises, consists of, or consists essentially of a nucleoside sequence differing by 0 or 1 nucleosides from any one of SEQ ID NOs: 42-61 or SEQ ID NOs: 302-401.

It is preferred herein that the duplex region is formed between a first (antisense) strand and a complementary second (sense) strand. Exemplary pairs of complementary antisense and sense strands are listed in Table 2 below:

TABLE 2

| SEQ ID NO (AS) | First (Antisense) Strand Base Sequence 5'→3' (Shown as an Unmodified Nucleoside Sequence) | SEQ ID NO (SS) | Second (Sense) Strand Base Sequence 5'→3' (Shown as an Unmodified Nucleoside Sequence) | Corresponding positions on NM_001497.4 |
|---|---|---|---|---|
| SEQ ID NO: 22 | AAUACAUAGGAAAUUCAAG | SEQ ID NO: 42 | CUUGAAUUUCCUAUGUAUU | 2210-2229 |
| SEQ ID NO: 23 | AAUUAUUAGGAAAUCCAUU | SEQ ID NO: 43 | AAUGGAUUUCCUAAUAAUU | 1068-1087 |
| SEQ ID NO: 24 | GACACCUCCAAAAUACUGA | SEQ ID NO: 44 | UCAGUAUUUUGGAGGUGUC | 1016-1035 |
| SEQ ID NO: 25 | AUAAUUAUUAGGAAAUCCA | SEQ ID NO: 45 | UGGAUUUCCUAAUAAUUAU | 1070-1089 |
| SEQ ID NO: 26 | AAAAUACAUAGGAAAUUCA | SEQ ID NO: 46 | UGAAUUUCCUAUGUAUUUU | 2212-2231 |
| SEQ ID NO: 27 | GUAUCUCUGUACAUCCAGC | SEQ ID NO: 47 | GCUGGAUGUACAGAGAUAC | 1301-1320 |
| SEQ ID NO: 28 | UUCUUUUAAGGCACUUUGG | SEQ ID NO: 48 | CCAAAGUGCCUUAAAAGAA | 3448-3467 |
| SEQ ID NO: 29 | GGAAAUUCAAGUUUACAUA | SEQ ID NO: 49 | UAUGUAAACUUGAAUUUCC | 2202-2221 |
| SEQ ID NO: 30 | AUUGCAACGGAAAUGUGCC | SEQ ID NO: 50 | GGCACAUUUCCGUUGCAAU | 967-986 |
| SEQ ID NO: 31 | AGGAAAUUCAAGUUUACAU | SEQ ID NO: 51 | AUGUAAACUUGAAUUUCCU | 2203-2222 |
| SEQ ID NO: 32 | UAAUUAUUAGGAAAUCCAU | SEQ ID NO: 52 | AUGGAUUUCCUAAUAAUUA | 1069-1088 |
| SEQ ID NO: 33 | UUUACUUAGAGCAGAGACA | SEQ ID NO: 53 | UGUCUCUGCUCUAAGUAAA | 1031-1050 |
| SEQ ID NO: 34 | UUUCUUUUAAGGCACUUUG | SEQ ID NO: 54 | CAAAGUGCCUUAAAAGAAA | 3449-3468 |
| SEQ ID NO: 35 | UAAUUAAAAGGCACAUUCA | SEQ ID NO: 55 | UGAAUGUGCCUUUUAAUUA | 2822-2841 |
| SEQ ID NO: 36 | AUACAUAGGAAAUUCAAGU | SEQ ID NO: 56 | ACUUGAAUUUCCUAUGUAU | 2209-2228 |
| SEQ ID NO: 37 | GGCACUUUGGAAAAGUCAG | SEQ ID NO: 57 | CUGACUUUUCCAAAGUGCC | 3439-3458 |
| SEQ ID NO: 38 | AUUAUUAGGAAAUCCAUUG | SEQ ID NO: 58 | CAAUGGAUUUCCUAAUAAU | 1067-1086 |
| SEQ ID NO: 39 | ACACCUCCAAAAUACUGAA | SEQ ID NO: 59 | UUCAGUAUUUUGGAGGUGU | 1015-1034 |
| SEQ ID NO: 40 | GCACUUUGGAAAAGUCAGG | SEQ ID NO: 60 | CCUGACUUUUCCAAAGUGC | 3438-3457 |
| SEQ ID NO: 41 | AAUAAUUAUUAGGAAAUCC | SEQ ID NO: 61 | GGAUUUCCUAAUAAUUAUU | 1071-1090 |
| SEQ ID NO: 202 | AUACAUAGGAAAUUCAAGUUUAC | SEQ ID NO: 302 | AAACUUGAAUUUCCUAUGUAU | 2209-2230 |
| SEQ ID NO: 203 | UAGGAAAUUCAAGUUUACAUAGC | SEQ ID NO: 303 | UAUGUAAACUUGAAUUUCCUA | 2204-2225 |
| SEQ ID NO: 204 | CAUAGGAAAUUCAAGUUUACAUA | SEQ ID NO: 304 | UGUAAACUUGAAUUUCCUAUG | 2206-2227 |
| SEQ ID NO: 205 | AAAAUACAUAGGAAAUUCAAGUU | SEQ ID NO: 305 | CUUGAAUUUCCUAUGUAUUUU | 2212-2233 |
| SEQ ID NO: 206 | AAAUACAUAGGAAAUUCAAGUUU | SEQ ID NO: 306 | ACUUGAAUUUCCUAUGUAUUU | 2211-2232 |

TABLE 2-continued

| SEQ ID NO (AS) | First (Antisense) Strand Base Sequence 5'→3' (Shown as an Unmodified Nucleoside Sequence) | SEQ ID NO (SS) | Second (Sense) Strand Base Sequence 5'→3' (Shown as an Unmodified Nucleoside Sequence) | Corresponding positions on NM_001497.4 |
|---|---|---|---|---|
| SEQ ID NO: 207 | AUAGGAAAUUCAAGUUUACAUAG | SEQ ID NO: 307 | AUGUAAACUUGAAUUUCCUAU | 2205-2226 |
| SEQ ID NO: 208 | AAAUUCAAGUUUACAUAGCAUGC | SEQ ID NO: 308 | AUGCUAUGUAAACUUGAAUUU | 2200-2221 |
| SEQ ID NO: 209 | ACUUUACAUUCAGAAAUCAGACA | SEQ ID NO: 309 | UCUGAUUUCUGAAUGUAAAGU | 2035-2056 |
| SEQ ID NO: 210 | UACAUAGGAAAUUCAAGUUUACA | SEQ ID NO: 310 | UAAACUUGAAUUUCCUAUGUA | 2208-2229 |
| SEQ ID NO: 211 | AUAAUUAUUAGGAAAUCCAUUGA | SEQ ID NO: 311 | AAUGGAUUUCCUAAUAAUUAU | 1070-1091 |
| SEQ ID NO: 212 | AAUAAUUAUUAGGAAAUCCAUUG | SEQ ID NO: 312 | AUGGAUUUCCUAAUAAUUAUU | 1071-1092 |
| SEQ ID NO: 213 | AAUUCAAGUUUACAUAGCAUGCC | SEQ ID NO: 313 | CAUGCUAUGUAAACUUGAAUU | 2199-2220 |
| SEQ ID NO: 214 | UUAGAGCAGAGACACCUCCAAAA | SEQ ID NO: 314 | UUGGAGGUGUCUCUGCUCUAA | 1026-1047 |
| SEQ ID NO: 215 | AUUCGGUCAAACCUCUGAGGAUU | SEQ ID NO: 315 | UCCUCAGAGGUUUGACCGAAU | 1225-1246 |
| SEQ ID NO: 216 | UAAUUAUUAGGAAAUCCAUUGAU | SEQ ID NO: 316 | CAAUGGAUUUCCUAAUAAUUA | 1069-1090 |
| SEQ ID NO: 217 | UUUUAAGGCACUUUGGAAAAGUC | SEQ ID NO: 317 | CUUUUCCAAAGUGCCUUAAAA | 3445-3466 |
| SEQ ID NO: 218 | GAAAUUCAAGUUUACAUAGCAUG | SEQ ID NO: 318 | UGCUAUGUAAACUUGAAUUUC | 2201-2222 |
| SEQ ID NO: 219 | AUUAUUAGGAAAUCCAUUGAUGG | SEQ ID NO: 319 | AUCAAUGGAUUUCCUAAUAAU | 1067-1088 |
| SEQ ID NO: 220 | AAUACAUAGGAAAUUCAAGUUUA | SEQ ID NO: 320 | AACUUGAAUUUCCUAUGUAUU | 2210-2231 |
| SEQ ID NO: 221 | AACUGUUGUUUACUUAGAGCAGA | SEQ ID NO: 321 | UGCUCUAAGUAAACAACAGUU | 1039-1060 |
| SEQ ID NO: 222 | GGAAAUUCAAGUUUACAUAGCAU | SEQ ID NO: 322 | GCUAUGUAAACUUGAAUUUCC | 2202-2223 |
| SEQ ID NO: 223 | UUUACUUAGAGCAGAGACACCUC | SEQ ID NO: 323 | GGUGUCUCUGCUCUAAGUAAA | 1031-1052 |
| SEQ ID NO: 224 | UAAUUAAAAGGCACAUUCAUGCU | SEQ ID NO: 324 | CAUGAAUGUGCCUUUUAAUUA | 2822-2843 |
| SEQ ID NO: 225 | UUACUUAGAGCAGAGACACCUCC | SEQ ID NO: 325 | AGGUGUCUCUGCUCUAAGUAA | 1030-1051 |
| SEQ ID NO: 226 | UUUCUUUUAAGGCACUUUGGAAA | SEQ ID NO: 326 | UCCAAAGUGCCUUAAAAGAAA | 3449-3470 |
| SEQ ID NO: 227 | AGGAAAUUCAAGUUUACAUAGCA | SEQ ID NO: 327 | CUAUGUAAACUUGAAUUUCCU | 2203-2224 |
| SEQ ID NO: 228 | AGAGACACCUCCAAAAUACUGAA | SEQ ID NO: 328 | CAGUAUUUUGGAGGUGUCUCU | 1019-1040 |
| SEQ ID NO: 229 | AUUAAAAGGCACAUUCAUGCUGG | SEQ ID NO: 329 | AGCAUGAAUGUGCCUUUUAAU | 2820-2841 |
| SEQ ID NO: 230 | GUUUACUUAGAGCAGAGACACCU | SEQ ID NO: 330 | GUGUCUCUGCUCUAAGUAAAC | 1032-1053 |

TABLE 2-continued

| SEQ ID NO (AS) | First (Antisense) Strand Base Sequence 5'→3' (Shown as an Unmodified Nucleoside Sequence) | SEQ ID NO (SS) | Second (Sense) Strand Base Sequence 5'→3' (Shown as an Unmodified Nucleoside Sequence) | Corresponding positions on NM_001497.4 |
|---|---|---|---|---|
| SEQ ID NO: 231 | AAAAUGUCAUCAUCUUC UCCUCC | SEQ ID NO: 331 | AGGAGAAGAUGAUGAC AUUUU | 1102-1123 |
| SEQ ID NO: 232 | ACUUAGAGCAGAGACAC CUCCAA | SEQ ID NO: 332 | GGAGGUGUCUCUGCUCU AAGU | 1028-1049 |
| SEQ ID NO: 233 | CUUUACAUUCAGAAAUC AGACAA | SEQ ID NO: 333 | GUCUGAUUUCUGAAUGU AAAG | 2034-2055 |
| SEQ ID NO: 234 | AUUGCAACGGAAAUGUG CCGUGG | SEQ ID NO: 334 | ACGGCACAUUUCCGUUG CAAU | 967-988 |
| SEQ ID NO: 235 | CCCAAUAAUUAUUAGGA AAUCCA | SEQ ID NO: 335 | GAUUUCCUAAUAAUUAU UGGG | 1074-1095 |
| SEQ ID NO: 236 | AGACACCUCCAAAAUAC UGAACA | SEQ ID NO: 336 | UUCAGUAUUUUGGAGG UGUCU | 1017-1038 |
| SEQ ID NO: 237 | AAUUAUUAGGAAAUCCA UUGAUG | SEQ ID NO: 337 | UCAAUGGAUUUCCUAAU AAUU | 1068-1089 |
| SEQ ID NO: 238 | UUCGGUCAAACCUCUGA GGAUUG | SEQ ID NO: 338 | AUCCUCAGAGGUUUGAC CGAA | 1224-1245 |
| SEQ ID NO: 239 | UAGGUGAGUGAGUUCAA ACCAUC | SEQ ID NO: 339 | UGGUUUGAACUCACUCA CCUA | 1276-1297 |
| SEQ ID NO: 240 | UUCUUUUAAGGCACUUU GGAAAA | SEQ ID NO: 340 | UUCCAAAGUGCCUUAAA AGAA | 3448-3469 |
| SEQ ID NO: 241 | CUUUUAAGGCACUUUGG AAAAGU | SEQ ID NO: 341 | UUUUCCAAAGUGCCUUA AAAG | 3446-3467 |
| SEQ ID NO: 242 | UGUUUACUUAGAGCAGA GACACC | SEQ ID NO: 342 | UGUCUCUGCUCUAAGUA AACA | 1033-1054 |
| SEQ ID NO: 243 | AGGCACUUUGGAAAAGU CAGGAU | SEQ ID NO: 343 | CCUGACUUUUCCAAAGU GCCU | 3440-3461 |
| SEQ ID NO: 244 | GAGCAGAGACACCUCCA AAAUAC | SEQ ID NO: 344 | AUUUUGGAGGUGUCUCU GCUC | 1023-1044 |
| SEQ ID NO: 245 | GUAGGUGAGUGAGUUCA AACCAU | SEQ ID NO: 345 | GGUUUGAACUCACUCAC CUAC | 1277-1298 |
| SEQ ID NO: 246 | UAGAGCAGAGACACCUC CAAAAU | SEQ ID NO: 346 | UUUGGAGGUGUCUCUGC UCUA | 1025-1046 |
| SEQ ID NO: 247 | GUUGUUUACUUAGAGCA GAGACA | SEQ ID NO: 347 | UCUCUGCUCUAAGUAAA CAAC | 1035-1056 |
| SEQ ID NO: 248 | UCCAUUGCAACGGAAAU GUGCCG | SEQ ID NO: 348 | GCACAUUUCCGUUGCAA UGGA | 970-991 |
| SEQ ID NO: 249 | CUAAUUAAAAGGCACAU UCAUGC | SEQ ID NO: 349 | AUGAAUGUGCCUUUUAA UUAG | 2823-2844 |
| SEQ ID NO: 250 | CAUUGCAACGGAAAUGU GCCGUG | SEQ ID NO: 350 | CGGCACAUUUCCGUUGC AAUG | 968-989 |
| SEQ ID NO: 251 | AUGUCCACUGUGAUUUG GGUAUA | SEQ ID NO: 351 | UACCCAAAUCACAGUGG ACAU | 1330-1351 |
| SEQ ID NO: 252 | GGUGUCCCGAUGUCCAC UGUGAU | SEQ ID NO: 352 | CACAGUGGACAUCGGGA CACC | 1339-1360 |
| SEQ ID NO: 253 | UUGUUUACUUAGAGCAG AGACAC | SEQ ID NO: 353 | GUCUCUGCUCUAAGUAA ACAA | 1034-1055 |

TABLE 2-continued

| SEQ ID NO (AS) | First (Antisense) Strand Base Sequence 5'→3' (Shown as an Unmodified Nucleoside Sequence) | SEQ ID NO (SS) | Second (Sense) Strand Base Sequence 5'→3' (Shown as an Unmodified Nucleoside Sequence) | Corresponding positions on NM_001497.4 |
|---|---|---|---|---|
| SEQ ID NO: 254 | CACUUUGGAAAAGUCAG GAUCUG | SEQ ID NO: 354 | GAUCCUGACUUUUCCAA AGUG | 3437-3458 |
| SEQ ID NO: 255 | AAUUAAAAGGCACAUUC AUGCUG | SEQ ID NO: 355 | GCAUGAAUGUGCCUUUU AAUU | 2821-2842 |
| SEQ ID NO: 256 | ACCUCCAAAAUACUGAA CAUAAG | SEQ ID NO: 356 | UAUGUUCAGUAUUUUG GAGGU | 1013-1034 |
| SEQ ID NO: 257 | CAAUAAUUAUUAGGAAA UCCAUU | SEQ ID NO: 357 | UGGAUUUCCUAAUAAUU AUUG | 1072-1093 |
| SEQ ID NO: 258 | UACUUAGAGCAGAGACA CCUCCA | SEQ ID NO: 358 | GAGGUGUCUCUGCUCUA AGUA | 1029-1050 |
| SEQ ID NO: 259 | GUAUCUCUGUACAUCCA GCACCU | SEQ ID NO: 359 | GUGCUGGAUGUACAGAG AUAC | 1301-1322 |
| SEQ ID NO: 260 | AAACUGUUGUUUACUUA GAGCAG | SEQ ID NO: 360 | GCUCUAAGUAAACAACA GUUU | 1040-1061 |
| SEQ ID NO: 261 | CUGUUGUUUACUUAGAG CAGAGA | SEQ ID NO: 361 | UCUGCUCUAAGUAAACA ACAG | 1037-1058 |
| SEQ ID NO: 262 | ACACCUCCAAAAUACUG AACAUA | SEQ ID NO: 362 | UGUUCAGUAUUUUGGA GGUGU | 1015-1036 |
| SEQ ID NO: 263 | AGAGCAGAGACACCUCC AAAAUA | SEQ ID NO: 363 | UUUUGGAGGUGUCUCUG CUCU | 1024-1045 |
| SEQ ID NO: 264 | CCGAUGUCCACUGUGAU UUGGGU | SEQ ID NO: 364 | CCAAAUCACAGUGGACA UCGG | 1333-1354 |
| SEQ ID NO: 265 | ACUGUUGUUUACUUAGA GCAGAG | SEQ ID NO: 365 | CUGCUCUAAGUAAACAA CAGU | 1038-1059 |
| SEQ ID NO: 266 | CUUAGAGCAGAGACACC UCCAAA | SEQ ID NO: 366 | UGGAGGUGUCUCUGCUC UAAG | 1027-1048 |
| SEQ ID NO: 267 | UCUUUUAAGGCACUUUG GAAAAG | SEQ ID NO: 367 | UUUCCAAAGUGCCUUAA AAGA | 3447-3468 |
| SEQ ID NO: 268 | GGUAUCUCUGUACAUCC AGCACC | SEQ ID NO: 368 | UGCUGGAUGUACAGAGA UACC | 1302-1323 |
| SEQ ID NO: 269 | GGCACUUUGGAAAAGUC AGGAUC | SEQ ID NO: 369 | UCCUGACUUUUCCAAAG UGCC | 3439-3460 |
| SEQ ID NO: 270 | CCACCUUGUGAGGAGAG ACGCAG | SEQ ID NO: 370 | GCGUCUCUCCUCACAAG GUGG | 684-705 |
| SEQ ID NO: 271 | CCAAUAAUUAUUAGGAA AUCCAU | SEQ ID NO: 371 | GGAUUUCCUAAUAAUUA UUGG | 1073-1094 |
| SEQ ID NO: 272 | CCAUUGCAACGGAAAUG UGCCGU | SEQ ID NO: 372 | GGCACAUUUCCGUUGCA AUGG | 969-990 |
| SEQ ID NO: 273 | GUCCACUGUGAUUUGGG UAUACA | SEQ ID NO: 373 | UAUACCCAAAUCACAGU GGAC | 1328-1349 |
| SEQ ID NO: 274 | GAGACACCUCCAAAAUA CUGAAC | SEQ ID NO: 374 | UCAGUAUUUUGGAGGU GUCUC | 1018-1039 |
| SEQ ID NO: 275 | UCCUUCAAGGCUUCUUG AAAGCC | SEQ ID NO: 375 | CUUUCAAGAAGCCUUGA AGGA | 862-883 |
| SEQ ID NO: 276 | UCUCCUCCCCAGCCCCAA UAAUU | SEQ ID NO: 376 | UUAUUGGGGCUGGGGA GGAGA | 1087-1108 |
| SEQ ID NO: 277 | GCUAGCUCGGUGUCCCG AUGUCC | SEQ ID NO: 377 | ACAUCGGGACACCGAGC UAGC | 1347-1368 |

TABLE 2-continued

| SEQ ID NO (AS) | First (Antisense) Strand Base Sequence 5'→3' (Shown as an Unmodified Nucleoside Sequence) | SEQ ID NO (SS) | Second (Sense) Strand Base Sequence 5'→3' (Shown as an Unmodified Nucleoside Sequence) | Corresponding positions on NM_001497.4 |
|---|---|---|---|---|
| SEQ ID NO: 278 | GCACUUUGGAAAAGUCA GGAUCU | SEQ ID NO: 378 | AUCCUGACUUUUCCAAA GUGC | 3438-3459 |
| SEQ ID NO: 279 | UGUCCACUGUGAUUUGG GUAUAC | SEQ ID NO: 379 | AUACCCAAAUCACAGUG GACA | 1329-1350 |
| SEQ ID NO: 280 | UGCUCCUGCCGGUUGCG GAAUGG | SEQ ID NO: 380 | AUUCCGCAACCGGCAGG AGCA | 718-739 |
| SEQ ID NO: 281 | GGGUAUCUCUGUACAUC CAGCAC | SEQ ID NO: 381 | GCUGGAUGUACAGAGAU ACCC | 1303-1324 |
| SEQ ID NO: 282 | ACCUUGUGAGGAGAGAC GCAGUC | SEQ ID NO: 382 | CUGCGUCUCUCCUCACA AGGU | 682-703 |
| SEQ ID NO: 283 | GUCCCGAUGUCCACUGU GAUUUG | SEQ ID NO: 383 | AAUCACAGUGGACAUCG GGAC | 1336-1357 |
| SEQ ID NO: 284 | UGUUGUUUACUUAGAGC AGAGAC | SEQ ID NO: 384 | CUCUGCUCUAAGUAAAC AACA | 1036-1057 |
| SEQ ID NO: 285 | GACACCUCCAAAAUACU GAACAU | SEQ ID NO: 385 | GUUCAGUAUUUUGGAG GUGUC | 1016-1037 |
| SEQ ID NO: 286 | UUCUCCUCCCCAGCCCCA AUAAU | SEQ ID NO: 386 | UAUUGGGGCUGGGGAG GAGAA | 1088-1109 |
| SEQ ID NO: 287 | CCUCCAAAAUACUGAAC AUAAGG | SEQ ID NO: 387 | UUAUGUUCAGUAUUUU GGAGG | 1012-1033 |
| SEQ ID NO: 288 | GAUGUCCACUGUGAUUU GGGUAU | SEQ ID NO: 388 | ACCCAAAUCACAGUGGA CAUC | 1331-1352 |
| SEQ ID NO: 289 | CCCCAAUAAUUAUUAGG AAAUCC | SEQ ID NO: 389 | AUUUCCUAAUAAUUAUU GGGG | 1075-1096 |
| SEQ ID NO: 290 | CGGUGUCCCGAUGUCCAC UGUGA | SEQ ID NO: 390 | ACAGUGGACAUCGGGAC ACCG | 1340-1361 |
| SEQ ID NO: 291 | UCCACUGUGAUUUGGGU AUACAA | SEQ ID NO: 391 | GUAUACCCAAAUCACAG UGGA | 1327-1348 |
| SEQ ID NO: 292 | AUCUUCUCCUCCCCAGCC CCAAU | SEQ ID NO: 392 | UGGGGCUGGGGAGGAG AAGAU | 1091-1112 |
| SEQ ID NO: 293 | CACCUCCAAAAUACUGA ACAUAA | SEQ ID NO: 393 | AUGUUCAGUAUUUUGG AGGUG | 1014-1035 |
| SEQ ID NO: 294 | CUAGCUCGGUGUCCCGA UGUCCA | SEQ ID NO: 394 | GACAUCGGGACACCGAG CUAG | 1346-1367 |
| SEQ ID NO: 295 | CUCGGUGUCCCGAUGUCC ACUGU | SEQ ID NO: 395 | AGUGGACAUCGGGACAC CGAG | 1342-1363 |
| SEQ ID NO: 296 | CUCCUCCCCAGCCCCAAU AAUUA | SEQ ID NO: 396 | AUUAUUGGGGCUGGGG AGGAG | 1086-1107 |
| SEQ ID NO: 297 | CAUCUUCUCCUCCCCAGC CCCAA | SEQ ID NO: 397 | GGGGCUGGGGAGGAGA AGAUG | 1092-1113 |
| SEQ ID NO: 298 | CCUUGUGAGGAGAGACG CAGUCC | SEQ ID NO: 398 | ACUGCGUCUCUCCUCAC AAGG | 681-702 |
| SEQ ID NO: 299 | UCCCCAGCCCCAAUAAUU AUUAG | SEQ ID NO: 399 | AAUAAUUAUUGGGGCU GGGGA | 1082-1103 |
| SEQ ID NO: 300 | GUGUCCCGAUGUCCACU GUGAUU | SEQ ID NO: 400 | UCACAGUGGACAUCGGG ACAC | 1338-1359 |
| SEQ ID NO: 301 | CACCUUGUGAGGAGAGA CGCAGU | SEQ ID NO: 401 | UGCGUCUCUCCUCACAA GGUG | 683-704 |

In a particular embodiment, the invention relates to a nucleic acid comprising first and second strands that comprise, consist of, or consist essentially of a nucleoside sequence differing by 0 or 1 nucleosides from any one of the following first and second sequences:

| Unmodified first strand | Unmodified second strand |
|---|---|
| SEQ ID NO: 202 | SEQ ID NO: 302 |
| SEQ ID NO: 205 | SEQ ID NO: 305 |
| SEQ ID NO: 217 | SEQ ID NO: 317 |
| SEQ ID NO: 228 | SEQ ID NO: 328 |

In certain embodiments, the nucleic acid for inhibiting expression of B4GALT1 comprises a duplex region that comprises a first strand and a second strand that is at least partially complementary to the first strand, wherein said first strand is:

(i) at least partially complementary to a portion of RNA transcribed from the B4GALT1 gene, and (ii) comprises at least 17 contiguous nucleosides differing by 0 or 1 nucleosides from any one of SEQ ID NOs: 62-81 or SEQ ID NOs: 402-513.

In certain embodiments, the first strand comprises nucleosides 2-18 of any one of the sequences set forth in SEQ ID NOs: 62-81 or SEQ ID NOs: 402-513.

In certain embodiments, the nucleic acid for inhibiting expression of B4GALT1 comprises a duplex region that comprises a first strand and a second strand that is at least partially complementary to the first strand, wherein said first strand is:

(i) at least partially complementary to a portion of RNA transcribed from the B4GALT1 gene, and (ii) comprises at least 21 contiguous nucleosides differing by 0 or 1 nucleosides from any one of SEQ ID NOs: 402-513.

In certain embodiments, the first strand comprises nucleosides 2-22 of any one of the sequences set forth in SEQ ID NOs: 402-513.

In certain embodiments, the first strand comprises any one of SEQ ID NOs: 62-81 or SEQ ID NOs: 402-513.

The modification pattern of the nucleic acids as set forth in SEQ ID NOs: 62-81 and SEQ ID NOs: 402-513 is summarized in Table 3 below:

TABLE 3

| Antisense strand ID | Modified First (Antisense) Strand 5' → 3' | SEQ ID NO (AS - mod) | Underlying Base Sequence 5' → 3' (Shown as an Unmodified Nucleoside Sequence) | SEQ ID NO (AS - unmod) |
|---|---|---|---|---|
| ETXS1238 | AmsAfsUmAfCmAfUmAfGmGfAmAfA mUfUmCfAmsAfsGm | SEQ ID NO: 62 | AAUACAUAGGAAAUUC AAG | SEQ ID NO: 22 |
| ETXS1240 | AmsAfsUmUfAmUfUmAfGmGfAmAfA mUfCmCfAmsUfsUm | SEQ ID NO: 63 | AAUUAUUAGGAAAUCC AUU | SEQ ID NO: 23 |
| ETXS1242 | GmsAfsCmAfCmCfUmCfCmAfAmAfAm UfAmCfUmsGfsAm | SEQ ID NO: 64 | GACACCUCCAAAAUAC UGA | SEQ ID NO: 24 |
| ETXS1244 | AmsUfsAmAfUmUfAmUfUmAfGmGfA mAfAmUfCmsCfsAm | SEQ ID NO: 65 | AUAAUUAUUAGGAAAU CCA | SEQ ID NO: 25 |
| ETXS1246 | AmsAfsAmAfUmAfCmAfUmAfGmGfA mAfAmUfUmsCfsAm | SEQ ID NO: 66 | AAAAUACAUAGGAAAU UCA | SEQ ID NO: 26 |
| ETXS1248 | GmsUfsAmUfCmUfCmUfGmUfAmCfA mUfCmCfAmsGfsCm | SEQ ID NO: 67 | GUAUCUCUGUACAUCC AGC | SEQ ID NO: 27 |
| ETXS1250 | UmsUfsCmUfUmUfUmAfAmGfGmCfA mCfUmUfUmsGfsGm | SEQ ID NO: 68 | UUCUUUUAAGGCACUU UGG | SEQ ID NO: 28 |
| ETXS1252 | GmsGfsAmAfAmUfUmCfAmAfGmUfU mUfAmCfAmsUfsAm | SEQ ID NO: 69 | GGAAAUUCAAGUUUAC AUA | SEQ ID NO: 29 |
| ETXS1254 | AmsUfsUmGfCmAfAmCfGmGfAmAfA mUfGmUfGmsCfsCm | SEQ ID NO: 70 | AUUGCAACGGAAAUGU GCC | SEQ ID NO: 30 |
| ETXS1256 | AmsGfsGmAfAmAfUmUfCmAfAmGfU mUfUmAfCmsAfsUm | SEQ ID NO: 71 | AGGAAAUUCAAGUUUA CAU | SEQ ID NO: 31 |
| ETXS1258 | UmsAfsAmUfUmAfUmUfAmGfGmAfA mAfUmCfCmsAfsUm | SEQ ID NO: 72 | UAAUUAUUAGGAAAUC CAU | SEQ ID NO: 32 |
| ETXS1260 | UmsUfsUmAfCmUfUmAfGmAfGmCfA mGfAmGfAmsCfsAm | SEQ ID NO: 73 | UUUACUUAGAGCAGAG ACA | SEQ ID NO: 33 |
| ETXS1262 | UmsUfsUmCfUmUfUmUfAmAfGmGfC mAfCmUfUmsUfsGm | SEQ ID NO: 74 | UUUCUUUUAAGGCACU UUG | SEQ ID NO: 34 |
| ETXS1264 | UmsAfsAmUfUmAfAmAfAmGfGmCfA mCfAmUfUmsCfsAm | SEQ ID NO: 75 | UAAUUAAAAGGCACAU UCA | SEQ ID NO: 35 |
| ETXS1266 | AmsUfsAmCfAmUfAmGfGmAfAmAfU mUfCmAfAmsGfsUm | SEQ ID NO: 76 | AUACAUAGGAAAUUCA AGU | SEQ ID NO: 36 |

TABLE 3-continued

| Antisense strand ID | Modified First (Antisense) Strand 5' → 3' | SEQ ID NO (AS - mod) | Underlying Base Sequence 5' → 3' (Shown as an Unmodified Nucleoside Sequence) | SEQ ID NO (AS - unmod) |
|---|---|---|---|---|
| ETXS1268 | GmsGfsCmAfCmUfUmUfGmGfAmAfA mAfGmUfCmsAfsGm | SEQ ID NO: 77 | GGCACUUUGGAAAAGU CAG | SEQ ID NO: 37 |
| ETXS1270 | AmsUfsUmAfUmUfAmGfGmAfAmAfU mCfCmAfUmsUfsGm | SEQ ID NO: 78 | AUUAUUAGGAAAUCCA UUG | SEQ ID NO: 38 |
| ETXS1272 | AmsCfsAmCfCmUfCmCfAmAfAmAfUm AfCmUfGmsAfsAm | SEQ ID NO: 79 | ACACCUCCAAAAUACU GAA | SEQ ID NO: 39 |
| ETXS1274 | GmsCfsAmCfUmUfUmGfGmAfAmAfA mGfUmCfAmsGfsGm | SEQ ID NO: 80 | GCACUUUGGAAAAGUC AGG | SEQ ID NO: 40 |
| ETXS1276 | AmsAfsUmAfAmUfUmAfUmUfAmGfG mAfAmAfUmsCfsCm | SEQ ID NO: 81 | AAUAAUUAUUAGGAAA UCC | SEQ ID NO: 41 |
| ETXS1038 | AmsAfsUmAmCmAfUmAfGfGmAmAm AmUfUmCfAmAmGmUmUmsUmsAm | SEQ ID NO: 402 | AAUACAUAGGAAAUUC AAGUUUA | SEQ ID NO: 220 |
| ETXS1040 | AmsAfsUmUmAmUfUmAfGfGmAmAm AmUfCmCfAmUmUmGmAmsUmsGm | SEQ ID NO: 403 | AAUUAUUAGGAAAUCC AUUGAUG | SEQ ID NO: 237 |
| ETXS1042 | GmsAfsCmAmCmCfUmCfCfAmAmAm AmUfAmCfUmGmAmAmCmsAmsUm | SEQ ID NO: 404 | GACACCUCCAAAAUAC UGAACAU | SEQ ID NO: 285 |
| ETXS1044 | AmsUfsAmAmUmUfAmUfUfAmGmGm AmAfAmUfCmCmAmUmUmsGmsAm | SEQ ID NO: 405 | AUAAUUAUUAGGAAAU CCAUUGA | SEQ ID NO: 211 |
| ETXS1046 | AmsAfsAmAmUmAfCmAfUfAmGmGm AmAfAmUfUmCmAmAmGmsUmsUm | SEQ ID NO: 406 | AAAAUACAUAGGAAAU UCAAGUU | SEQ ID NO: 205 |
| ETXS1048 | GmsUfsAmUmCmUfCmUfGfUmAmCm AmUfCmCfAmGmCmAmCmsCmsUm | SEQ ID NO: 407 | GUAUCUCUGUACAUCC AGCACCU | SEQ ID NO: 259 |
| ETXS1050 | UmsUfsCmUmUmUfUmAfAfGmGmCm AmCfUmUfUmGmGmAmAmsAmsAm | SEQ ID NO: 408 | UUCUUUUAAGGCACUU UGGAAAA | SEQ ID NO: 240 |
| ETXS1052 | GmsGfsAmAmAmUfUmCfAfAmGmUm UmUfAmCfAmUmAmGmCmsAmsUm | SEQ ID NO: 409 | GGAAAUUCAAGUUUAC AUAGCAU | SEQ ID NO: 222 |
| ETXS1054 | AmsUfsUmGmCmAfAmCfGfGmAmAm AmUfGmUfGmCmCmGmUmsGmsGm | SEQ ID NO: 410 | AUUGCAACGGAAAUGU GCCGUGG | SEQ ID NO: 234 |
| ETXS1056 | AmsGfsGmAmAmAfUmUfCfAmAmGm UmUfUmAfCmAmUmAmGmsCmsAm | SEQ ID NO: 411 | AGGAAAUUCAAGUUUA CAUAGCA | SEQ ID NO: 227 |
| ETXS1058 | UmsAfsAmUmUmAfUmUfAfGmGmAm AmAfUmCfCmAmUmUmGmsAmsUm | SEQ ID NO: 412 | UAAUUAUUAGGAAAUC CAUUGAU | SEQ ID NO: 216 |
| ETXS1060 | UmsUfsUmAmCmUfUmAfGfAmGmCm AmGfAmGfAmCmAmCmCmsUmsCm | SEQ ID NO: 413 | UUUACUUAGAGCAGAG ACACCUC | SEQ ID NO: 223 |
| ETXS1062 | UmsUfsUmCmUmUfUmUfAfAmGmGm CmAfCmUfUmUmGmGmAmsAmsAm | SEQ ID NO: 414 | UUUCUUUUAAGGCACU UUGGAAA | SEQ ID NO: 226 |
| ETXS1064 | UmsAfsAmUmUmAfAmAfAfGmGmCm AmCfAmUfUmCmAmUmGmsCmsUm | SEQ ID NO: 415 | UAAUUAAAAGGCACAU UCAUGCU | SEQ ID NO: 224 |
| ETXS1066 | AmsUfsAmCmAmUfAmGfGfAmAmAm UmUfCmAfAmGmUmUmUmsAmsCm | SEQ ID NO: 416 | AUACAUAGGAAAUUCA AGUUUAC | SEQ ID NO: 202 |
| ETXS1068 | GmsGfsCmAmCmUfUmUfGfGmAmAm AmAfGmUfCmAmGmGmAmsUmsCm | SEQ ID NO: 417 | GGCACUUUGGAAAAGU CAGGAUC | SEQ ID NO: 269 |
| ETXS1070 | AmsUfsUmAmUmUfAmGfGfAmAmAm UmCfCmAfUmUmGmAmUmsGmsGm | SEQ ID NO: 418 | AUUAUUAGGAAAUCCA UUGAUGG | SEQ ID NO: 219 |
| ETXS1072 | AmsCfsAmCmCmUfCmCfAfAmAmAm UmAfCmUfGmAmAmCmAmsUmsAm | SEQ ID NO: 419 | ACACCUCCAAAAUACU GAACAUA | SEQ ID NO: 262 |
| ETXS1074 | GmsCfsAmCmUmUfUmGfGfAmAmAm AmGfUmCfAmGmGmAmUmsCmsUm | SEQ ID NO: 420 | GCACUUUGGAAAAGUC AGGAUCU | SEQ ID NO: 278 |
| ETXS1076 | AmsAfsUmAmAmUfUmAfUfUmAmGm GmAfAmAfUmCmCmAmUmsUmsGm | SEQ ID NO: 421 | AAUAAUUAUUAGGAAA UCCAUUG | SEQ ID NO: 212 |

TABLE 3-continued

| Antisense strand ID | Modified First (Antisense) Strand 5' → 3' | SEQ ID NO (AS - mod) | Underlying Base Sequence 5' → 3' (Shown as an Unmodified Nucleoside Sequence) | SEQ ID NO (AS - unmod) |
|---|---|---|---|---|
| ETXS1078 | AmsUfsUmAmAmAfAmGfGfCmAmCm AmUfUmCfAmUmGmCmUmsGmsGm | SEQ ID NO: 422 | AUUAAAAGGCACAUUC AUGCUGG | SEQ ID NO: 229 |
| ETXS1080 | UmsGfsUmUmUmAfCmUfUfAmGmAm GmCfAmGfAmGmAmCmAmsCmsCm | SEQ ID NO: 423 | UGUUUACUUAGAGCAG AGACACC | SEQ ID NO: 242 |
| ETXS1082 | CmsAfsCmCmUmCfCmAfAfAmAmUm AmCfUmGfAmAmCmAmUmsAmsAm | SEQ ID NO: 424 | CACCUCCAAAAUACUG AACAUAA | SEQ ID NO: 293 |
| ETXS1084 | CmsAfsCmUmUmUfGmGfAfAmAmAm GmUfCmAfGmGmAmUmCmsUmsGm | SEQ ID NO: 425 | CACUUUGGAAAAGUCA GGAUCUG | SEQ ID NO: 254 |
| ETXS1086 | AmsAfsAmUmUmCfAmAfGfUmUmUm AmCfAmUfAmGmCmAmUmsGmsCm | SEQ ID NO: 426 | AAAUUCAAGUUUACAU AGCAUGC | SEQ ID NO: 208 |
| ETXS1088 | AmsAfsAmCmUmGfUmUfGfUmUmUm AmCfUmUfAmGmAmGmCmsAmsGm | SEQ ID NO: 427 | AAACUGUUGUUUACUU AGAGCAG | SEQ ID NO: 260 |
| ETXS1090 | GmsGfsGmUmAmUfCmUfCfUmGmUm AmCfAmUfCmCmAmGmCmsAmsCm | SEQ ID NO: 428 | GGGUAUCUCUGUACAU CCAGCAC | SEQ ID NO: 281 |
| ETXS1092 | GmsUfsUmGmUmUfUmAfCfUmUmAm GmAfGmCfAmGmAmGmAmsCmsAm | SEQ ID NO: 429 | GUUGUUUACUUAGAGC AGAGACA | SEQ ID NO: 247 |
| ETXS1094 | UmsAfsGmGmAmAfAmUfUfCmAmAm GmUfUmUfAmCmAmUmAmsGmsCm | SEQ ID NO: 430 | UAGGAAAUUCAAGUUU ACAUAGC | SEQ ID NO: 203 |
| ETXS1096 | AmsUfsGmUmCmCfAmCfUfGmUmGm AmUfUmUfGmGmGmUmAmsUmsAm | SEQ ID NO: 431 | AUGUCCACUGUGAUUU GGGUAUA | SEQ ID NO: 251 |
| ETXS1098 | AmsUfsUmCmGmGfUmCfAfAmAmCm CmUfCmUfGmAmGmGmAmsUmsUm | SEQ ID NO: 432 | AUUCGGUCAAACCUCU GAGGAUU | SEQ ID NO: 215 |
| ETXS1100 | AmsAfsAmUmAmCfAmUfAfGmGmAm AmAfUmUfCmAmAmGmUmsUmsUm | SEQ ID NO: 433 | AAAUACAUAGGAAAUU CAAGUUU | SEQ ID NO: 206 |
| ETXS1102 | CmsUfsAmAmUmUfAmAfAfAmGmGm CmAfCmAfUmUmCmAmUmsGmsCm | SEQ ID NO: 434 | CUAAUUAAAAGGCACA UUCAUGC | SEQ ID NO: 249 |
| ETXS1104 | CmsCfsAmCmCmUfUmGfUfGmAmGm GmAfGmAfGmAmCmGmCmsAmsGm | SEQ ID NO: 435 | CCACCUUGUGAGGAGA GACGCAG | SEQ ID NO: 270 |
| ETXS1106 | UmsGfsUmCmCmAfCmUfGfUmGmAm UmUfUmGfGmGmUmAmUmsAmsCm | SEQ ID NO: 436 | UGUCCACUGUGAUUUG GGUAUAC | SEQ ID NO: 279 |
| ETXS1108 | UmsAfsCmAmUmAfGmGfAfAmAmUm UmCfAmAfGmUmUmUmAmsCmsAm | SEQ ID NO: 437 | UACAUAGGAAAUUCAA GUUUACA | SEQ ID NO: 210 |
| ETXS1110 | CmsUfsUmUmAmCfAmUfUfCmAmGm AmAfAmUfCmAmGmAmCmsAmsAm | SEQ ID NO: 438 | CUUUACAUUCAGAAAU CAGACAA | SEQ ID NO: 233 |
| ETXS1112 | CmsCfsAmAmUmAfAmUfUfAmUmUm AmGfGmAfAmAmUmCmCmsAmsUm | SEQ ID NO: 439 | CCAAUAAUUAUUAGGA AAUCCAU | SEQ ID NO: 271 |
| ETXS1114 | UmsGfsCmUmCmCfUmGfCfCmGmGm UmUfGmCfGmGmAmAmUmsGmsGm | SEQ ID NO: 440 | UGCUCCUGCCGGUUGC GGAAUGG | SEQ ID NO: 280 |
| ETXS1116 | UmsUfsGmUmUmUfAmCfUfUmAmGm AmGfCmAfGmAmGmAmCmsAmsCm | SEQ ID NO: 441 | UUGUUUACUUAGAGCA GAGACAC | SEQ ID NO: 253 |
| ETXS1118 | AmsCfsUmGmUmUfGmUfUfUmAmCm UmUfAmGfAmGmCmAmGmsAmsGm | SEQ ID NO: 442 | ACUGUUGUUUACUUAG AGCAGAG | SEQ ID NO: 265 |
| ETXS1120 | CmsUfsUmUmUmAfAmGfGfCmAmCm UmUfUmGfGmAmAmAmAmsGmsUm | SEQ ID NO: 443 | CUUUUAAGGCACUUUG GAAAAGU | SEQ ID NO: 241 |
| ETXS1122 | AmsCfsCmUmCmCfAmAfAfAmUmAm CmUfGmAfAmCmAmUmAmsAmsGm | SEQ ID NO: 444 | ACCUCCAAAAUACUGA ACAUAAG | SEQ ID NO: 256 |
| ETXS1124 | CmsGfsGmUmGmUfCmCfCfGmAmUm GmUfCmCfAmCmUmGmUmsGmsAm | SEQ ID NO: 445 | CGGUGUCCCGAUGUCC ACUGUGA | SEQ ID NO: 290 |
| ETXS1126 | CmsCfsCmCmAmAfUmAfAfUmUmAm UmUfAmGfGmAmAmAmUmsCmsCm | SEQ ID NO: 446 | CCCCAAUAAUUAUUAG GAAAUCC | SEQ ID NO: 289 |

TABLE 3-continued

| Antisense strand ID | Modified First (Antisense) Strand 5' → 3' | SEQ ID NO (AS - mod) | Underlying Base Sequence 5' → 3' (Shown as an Unmodified Nucleoside Sequence) | SEQ ID NO (AS - unmod) |
|---|---|---|---|---|
| ETXS1128 | GmsAfsUmGmUmCfCmAfCfUmGmUm GmAfUmUfUmGmGmGmUmsAmsUm | SEQ ID NO: 447 | GAUGUCCACUGUGAUU UGGGUAU | SEQ ID NO: 288 |
| ETXS1130 | UmsAfsGmAmGmCfAmGfAfGmAmCm AmCfCmUfCmCmAmAmAmsAmsUm | SEQ ID NO: 448 | UAGAGCAGAGACACCU CCAAAAU | SEQ ID NO: 246 |
| ETXS1132 | CmsCfsGmAmUmGfUmCfCfAmCmUm GmUfGmAfUmUmUmGmGmsGmsUm | SEQ ID NO: 449 | CCGAUGUCCACUGUGA UUUGGGU | SEQ ID NO: 264 |
| ETXS1134 | UmsCfsUmUmUmUfAmAfGfGmCmAm CmUfUmUfGmGmAmAmAmsAmsGm | SEQ ID NO: 450 | UCUUUUAAGGCACUUU GGAAAAG | SEQ ID NO: 267 |
| ETXS1136 | CmsCfsCmAmAmUfAmAfUfUmAmUm UmAfGmGfAmAmAmUmCmsCmsAm | SEQ ID NO: 451 | CCCAAUAAUUAUUAGG AAAUCCA | SEQ ID NO: 235 |
| ETXS1138 | GmsUfsCmCmAmCfUmGfUfGmAmUm UmUfGmGfGmUmAmUmAmsCmsAm | SEQ ID NO: 452 | GUCCACUGUGAUUUGG GUAUACA | SEQ ID NO: 273 |
| ETXS1140 | GmsUfsAmGmGmUfGmAfGfUmGmAm GmUfUmCfAmAmAmCmCmsAmsUm | SEQ ID NO: 453 | GUAGGUGAGUGAGUUC AAACCAU | SEQ ID NO: 245 |
| ETXS1142 | AmsCfsUmUmAmGfAmGfCfAmGmAm GmAfCmAfCmCmUmCmCmsAmsAm | SEQ ID NO: 454 | ACUUAGAGCAGAGACA CCUCCAA | SEQ ID NO: 232 |
| ETXS1144 | CmsAfsCmCmUmUfGmUfGfAmGmGm AmGfAmGfAmCmGmCmAmsGmsUm | SEQ ID NO: 455 | CACCUUGUGAGGAGAG ACGCAGU | SEQ ID NO: 301 |
| ETXS1146 | AmsAfsAmAmUmGfUmCfAfUmCmAm UmCfUmUfCmUmCmCmUmsCmsCm | SEQ ID NO: 456 | AAAAUGUCAUCAUCUU CUCCUCC | SEQ ID NO: 231 |
| ETXS1148 | CmsUfsUmAmGmAfGmCfAfGmAmGm AmCfAmCfCmUmCmCmAmsAmsAm | SEQ ID NO: 457 | CUUAGAGCAGAGACAC CUCCAAA | SEQ ID NO: 266 |
| ETXS1150 | UmsCfsUmCmCmUfCmCfCfCmAmGmC mCfCmCfAmAmUmAmAmsUmsUm | SEQ ID NO: 458 | UCUCCUCCCCAGCCCCA AUAAUU | SEQ ID NO: 276 |
| ETXS1152 | AmsGfsGmCmAmCfUmUfUfGmGmAm AmAfAmGfUmCmAmGmGmsAmsUm | SEQ ID NO: 459 | AGGCACUUUGGAAAAG UCAGGAU | SEQ ID NO: 243 |
| ETXS1154 | CmsCfsAmUmUmGfCmAfAfCmGmGm AmAfAmUfGmUmGmCmCmsGmsUm | SEQ ID NO: 460 | CCAUUGCAACGGAAAU GUGCCGU | SEQ ID NO: 272 |
| ETXS1156 | AmsAfsCmUmGmUfUmGfUfUmUmAm CmUfUmAfGmAmGmCmAmsGmsAm | SEQ ID NO: 461 | AACUGUUGUUUACUUA GAGCAGA | SEQ ID NO: 221 |
| ETXS1158 | UmsUfsAmGmAmGfCmAfGfAmGmAm CmAfCmCfUmCmCmAmAmsAmsAm | SEQ ID NO: 462 | UUAGAGCAGAGACACC UCCAAAA | SEQ ID NO: 214 |
| ETXS1160 | GmsAfsAmAmUmUfCmAfAfGmUmUm UmAfCmAfUmAmGmCmAmsUmsGm | SEQ ID NO: 463 | GAAAUUCAAGUUUACA UAGCAUG | SEQ ID NO: 218 |
| ETXS1162 | CmsAfsAmUmAmAfUmUfAfUmUmAm GmGfAmAfAmUmCmCmAmsUmsUm | SEQ ID NO: 464 | CAAUAAUUAUUAGGAA AUCCAUU | SEQ ID NO: 257 |
| ETXS1164 | CmsUfsCmCmUmCfCmCfCfAmGmCmC mCfCmAfAmUmAmAmUmsUmsAm | SEQ ID NO: 465 | CUCCUCCCCAGCCCCAA UAAUUA | SEQ ID NO: 296 |
| ETXS1166 | UmsUfsUmUmAmAfGmGfCfAmCmUm UmUfGmGfAmAmAmAmGmsUmsCm | SEQ ID NO: 466 | UUUUAAGGCACUUUGG AAAAGUC | SEQ ID NO: 217 |
| ETXS1168 | UmsUfsCmUmCmCfUmCfCfCmCmAmG mCfCmCfCmAmAmUmAmsAmsUm | SEQ ID NO: 467 | UUCUCCUCCCCAGCCCC AAUAAU | SEQ ID NO: 286 |
| ETXS1170 | CmsUfsAmGmCmUfCmGfGfUmGmUm CmCfCmGfAmUmGmUmCmsCmsAm | SEQ ID NO: 468 | CUAGCUCGGUGUCCCG AUGUCCA | SEQ ID NO: 294 |
| ETXS1172 | AmsGfsAmCmAmCfCmUfCfCmAmAm AmAfUmAfCmUmGmAmAmsCmsAm | SEQ ID NO: 469 | AGACACCUCCAAAAUA CUGAACA | SEQ ID NO: 236 |
| ETXS1174 | UmsAfsCmUmUmAfGmAfGfCmAmGm AmGfAmCfAmCmCmUmCmsCmsAm | SEQ ID NO: 470 | UACUUAGAGCAGAGAC ACCUCCA | SEQ ID NO: 258 |
| ETXS1176 | UmsAfsGmGmUmGfAmGfUfGmAmGm UmUfCmAfAmAmCmCmAmsUmsCm | SEQ ID NO: 471 | UAGGUGAGUGAGUUCA AACCAUC | SEQ ID NO: 239 |

TABLE 3-continued

| Antisense strand ID | Modified First (Antisense) Strand 5' → 3' | SEQ ID NO (AS - mod) | Underlying Base Sequence 5' → 3' (Shown as an Unmodified Nucleoside Sequence) | SEQ ID NO (AS - unmod) |
|---|---|---|---|---|
| ETXS1178 | AmsCfsUmUmUmAfCmAfUfUmCmAm GmAfAmAfUmCmAmGmAmsCmsAm | SEQ ID NO: 472 | ACUUUACAUUCAGAAA UCAGACA | SEQ ID NO: 209 |
| ETXS1180 | CmsAfsUmAmGmGfAmAfAfUmUmCm AmAfGmUfUmUmAmCmAmsUmsAm | SEQ ID NO: 473 | CAUAGGAAAUUCAAGU UUACAUA | SEQ ID NO: 204 |
| ETXS1182 | GmsUfsUmUmAmCfUmUfAfGmAmGm CmAfGmAfGmAmCmAmCmsCmsUm | SEQ ID NO: 474 | GUUUACUUAGAGCAGA GACACCU | SEQ ID NO: 230 |
| ETXS1184 | AmsCfsCmUmUmGfUmGfAfGmGmAm GmAfGmAfCmGmCmAmGmsUmsCm | SEQ ID NO: 475 | ACCUUGUGAGGAGAGA CGCAGUC | SEQ ID NO: 282 |
| ETXS1186 | CmsCfsUmCmCmAfAmAfAfUmAmCm UmGfAmAfCmAmUmAmAmsGmsGm | SEQ ID NO: 476 | CCUCCAAAAUACUGAA CAUAAGG | SEQ ID NO: 287 |
| ETXS1188 | GmsGfsUmGmUmCfCmCfGfAmUmGm UmCfCmAfCmUmGmUmGmsAmsUm | SEQ ID NO: 477 | GGUGUCCCGAUGUCCA CUGUGAU | SEQ ID NO: 252 |
| ETXS1190 | CmsUfsGmUmUmGfUmUfUfAmCmUm UmAfGmAfGmCmAmGmAmsGmsAm | SEQ ID NO: 478 | CUGUUGUUUACUUAGA GCAGAGA | SEQ ID NO: 261 |
| ETXS1192 | CmsAfsUmUmGmCfAmAfCfGmGmAm AmAfUmGfUmGmCmCmGmsUmsGm | SEQ ID NO: 479 | CAUUGCAACGGAAAUG UGCCGUG | SEQ ID NO: 250 |
| ETXS1194 | GmsAfsGmAmCmAfCmCfUfCmCmAm AmAfAmUfAmCmUmGmAmsAmsCm | SEQ ID NO: 480 | GAGACACCUCCAAAAU ACUGAAC | SEQ ID NO: 274 |
| ETXS1196 | UmsCfsCmAmUmUfGmCfAfAmCmGm GmAfAmAfUmGmUmGmCmsCmsGm | SEQ ID NO: 481 | UCCAUUGCAACGGAAA UGUGCCG | SEQ ID NO: 248 |
| ETXS1198 | AmsAfsUmUmCmAfAmGfUfUmUmAm CmAfUmAfGmCmAmUmGmsCmsCm | SEQ ID NO: 482 | AAUUCAAGUUUACAUA GCAUGCC | SEQ ID NO: 213 |
| ETXS1200 | UmsUfsCmGmGmUfCmAfAfAmCmCm UmCfUmGfAmGmGmAmUmsUmsGm | SEQ ID NO: 483 | UUCGGUCAAACCUCUG AGGAUUG | SEQ ID NO: 238 |
| ETXS1202 | GmsUfsGmUmCmCfCmGfAfUmGmUm CmCfAmCfUmGmUmGmAmsUmsUm | SEQ ID NO: 484 | GUGUCCCGAUGUCCAC UGUGAUU | SEQ ID NO: 300 |
| ETXS1204 | UmsCfsCmUmUmCfAmAfGfGmCmUm UmCfUmUfGmAmAmAmGmsCmsCm | SEQ ID NO: 485 | UCCUUCAAGGCUUCUU GAAAGCC | SEQ ID NO: 275 |
| ETXS1206 | UmsUfsAmCmUmUfAmGfAfGmCmAm GmAfGmAfCmAmCmCmUmsCmsCm | SEQ ID NO: 486 | UUACUUAGAGCAGAGA CACCUCC | SEQ ID NO: 225 |
| ETXS1208 | AmsGfsAmGmCmAfGmAfGfAmCmAm CmCfUmCfCmAmAmAmAmsUmsAm | SEQ ID NO: 487 | AGAGCAGAGACACCUC CAAAAUA | SEQ ID NO: 263 |
| ETXS1210 | AmsAfsUmUmAmAfAmAfGfGmCmAm CmAfUmUfCmAmUmGmCmsUmsGm | SEQ ID NO: 488 | AAUUAAAAGGCACAUU CAUGCUG | SEQ ID NO: 255 |
| ETXS1212 | GmsCfsUmAmGmCfUmCfGfGmUmGm UmCfCmCfGmAmUmGmUmsCmsCm | SEQ ID NO: 489 | GCUAGCUCGGUGUCCC GAUGUCC | SEQ ID NO: 277 |
| ETXS1214 | CmsCfsUmUmGmUfGmAfGfGmAmGm AmGfAmCfGmCmAmGmUmsCmsCm | SEQ ID NO: 490 | CCUUGUGAGGAGAGAC GCAGUCC | SEQ ID NO: 298 |
| ETXS1216 | UmsCfsCmAmCmUfGmUfGfAmUmUm UmGfGmGfUmAmUmAmCmsAmsAm | SEQ ID NO: 491 | UCCACUGUGAUUUGGG UAUACAA | SEQ ID NO: 291 |
| ETXS1218 | GmsGfsUmAmUmCfUmCfUfGmUmAm CmAfUmCfCmAmGmCmAmsCmsCm | SEQ ID NO: 492 | GGUAUCUCUGUACAUC CAGCACC | SEQ ID NO: 268 |
| ETXS1220 | AmsUfsAmGmGmAfAmAfUfUmCmAm AmGfUmUfUmAmCmAmUmsAmsGm | SEQ ID NO: 493 | AUAGGAAAUUCAAGUU UACAUAG | SEQ ID NO: 207 |
| ETXS1222 | CmsAfsUmCmUmUfCmUfCfCmUmCmC mCfCmAfGmCmCmCmCmsAmsAm | SEQ ID NO: 494 | CAUCUUCUCCUCCCCA GCCCCAA | SEQ ID NO: 297 |
| ETXS1224 | UmsGfsUmUmGmUfUmUfAfCmUmUm AmGfAmGfCmAmGmAmGmsAmsCm | SEQ ID NO: 495 | UGUUGUUUACUUAGAG CAGAGAC | SEQ ID NO: 284 |
| ETXS1226 | AmsUfsCmUmUmCfUmCfCfUmCmCmC mCfAmGfCmCmCmCmAmsAmsUm | SEQ ID NO: 496 | AUCUUCUCCUCCCCAG CCCCAAU | SEQ ID NO: 292 |

TABLE 3-continued

| Antisense strand ID | Modified First (Antisense) Strand 5' → 3' | SEQ ID NO (AS - mod) | Underlying Base Sequence 5' → 3' (Shown as an Unmodified Nucleoside Sequence) | SEQ ID NO (AS - unmod) |
|---|---|---|---|---|
| ETXS1228 | GmsUfsCmCmCmGfAmUfGfUmCmCm AmCfUmGfUmGmAmUmUmsUmsGm | SEQ ID NO: 497 | GUCCCGAUGUCCACUG UGAUUUG | SEQ ID NO: 283 |
| ETXS1230 | CmsUfsCmGmGmUfGmUfCfCmCmGm AmUfGmUfCmCmAmCmUmsGmsUm | SEQ ID NO: 498 | CUCGGUGUCCCGAUGU CCACUGU | SEQ ID NO: 295 |
| ETXS1232 | UmsCfsCmCmCmAfGmCfCfCmCmAmA mUfAmAfUmUmAmUmUmsAmsGm | SEQ ID NO: 499 | UCCCCAGCCCCAAUAA UUAUUAG | SEQ ID NO: 299 |
| ETXS1234 | AmsGfsAmGmAmCfAmCfCfUmCmCm AmAfAmAfUmAmCmUmGmsAmsAm | SEQ ID NO: 500 | AGAGACACCUCCAAAA UACUGAA | SEQ ID NO: 228 |
| ETXS1236 | GmsAfsGmCmAmGfAmGfAfCmAmCm CmUfCmCfAmAmAmAmUmsAmsCm | SEQ ID NO: 501 | GAGCAGAGACACCUCC AAAAUAC | SEQ ID NO: 244 |
| ETXS2400 | AmsUfsAmCfAmUfAmGmGmAmAmA mUmUfCmAfAmGmUmUmUmsAmsCm | SEQ ID NO: 502 | AUACAUAGGAAAUUCA AGUUUAC | SEQ ID NO: 202 |
| ETXS2402 | AmsUfsAmCmAmUfAmGmGfAmAmA mUmUfCmAfAmGmUmUmUmsAmsCm | SEQ ID NO: 503 | AUACAUAGGAAAUUCA AGUUUAC | SEQ ID NO: 202 |
| ETXS2406 | AmsAfsAmAfUmAfCmAmUmAmGmG mAmAfAmUfUmCmAmAmGmsUmsUm | SEQ ID NO: 504 | AAAAUACAUAGGAAAU UCAAGUU | SEQ ID NO: 205 |
| ETXS2408 | AmsAfsAmAmUmAfCmAmUfAmGmG mAmAfAmUfUmCmAmAmGmsUmsUm | SEQ ID NO: 505 | AAAAUACAUAGGAAAU UCAAGUU | SEQ ID NO: 205 |
| ETXS2424 | UmsUfsUmUfAmAfGmGmCmAmCmUm UmUfGmGfAmAmAmAmGmsUmsCm | SEQ ID NO: 506 | UUUUAAGGCACUUUGG AAAAGUC | SEQ ID NO: 217 |
| ETXS2426 | UmsUfsUmUmAmAfGmGmCfAmCmUm UmUfGmGfAmAmAmAmGmsUmsCm | SEQ ID NO: 507 | UUUUAAGGCACUUUGG AAAAGUC | SEQ ID NO: 217 |
| ETXS2430 | AmsGfsAmGfAmCfAmCmCmUmCmCm AmAfAmAfUmAmCmUmGmsAmsAm | SEQ ID NO: 508 | AGAGACACCUCCAAAA UACUGAA | SEQ ID NO: 228 |
| ETXS2432 | AmsGfsAmGmAmCfAmCmCfUmCmCm AmAfAmAfUmAmCmUmGmsAmsAm | SEQ ID NO: 509 | AGAGACACCUCCAAAA UACUGAA | SEQ ID NO: 228 |
| ETXS2434 | AmsUfsAmCmAmUfAmGmGmAmAmA mUmUfCmAfAmGfUmUmUmsAmsCm | SEQ ID NO: 510 | AUACAUAGGAAAUUCA AGUUUAC | SEQ ID NO: 202 |
| ETXS2436 | AmsAfsAmAmUmAfCmAmUmAmGmG mAmAfAmUfUmCfAmAmGmsUmsUm | SEQ ID NO: 511 | AAAAUACAUAGGAAAU UCAAGUU | SEQ ID NO: 205 |
| ETXS2438 | UmsUfsUmUmAmAfGmGmCmAmCmU mUmUfGmGfAmAfAmAmGmsUmsCm | SEQ ID NO: 512 | UUUUAAGGCACUUUGG AAAAGUC | SEQ ID NO: 217 |
| ETXS2440 | AmsGfsAmGmAmCfAmCmCmUmCmC mAmAfAmAfUmAfCmUmGmsAmsAm | SEQ ID NO: 513 | AGAGACACCUCCAAAA UACUGAA | SEQ ID NO: 228 |

In certain embodiments, the second strand comprises a nucleoside sequence of at least 17 contiguous nucleosides differing by 0 or 1 nucleosides from any one of SEQ ID NOs: 82-101 or SEQ ID NOs: 514-621; wherein the second strand has a region of at least 85% complementarity over the 17 contiguous nucleosides to the first strand.

In certain embodiments, the second strand comprises a nucleoside sequence of at least 19 contiguous nucleosides differing by 0 or 1 nucleosides from any one of SEQ ID NOs: 514-621; wherein the second strand has a region of at least 85% complementarity over the 19 contiguous nucleosides to the first strand.

In certain embodiments, the second strand comprises a nucleoside sequence of at least 21 contiguous nucleosides differing by 0 or 1 nucleosides from any one of SEQ ID NOs: 514-621; wherein the second strand has a region of at least 85% complementarity over the 21 contiguous nucleosides to the first strand.

In certain embodiments, the second strand comprises any one of SEQ ID NOs: 82-101 or SEQ ID NOs: 514-621.

The modification pattern of the nucleic acids as set forth in SEQ ID NOs: 82-101 and SEQ ID NOs: 514-621 is summarized in Table 4 below:

TABLE 4

| Sense strand ID | Modified Second (Sense) Strand 5' → 3' | SEQ ID NO (SS - mod) | Underlying Base Sequence 5' → 3' (Shown as an Unmodified Nucleoside Sequence) | SEQ ID NO (SS - unmod) |
|---|---|---|---|---|
| ETXS1237 | CfsUmsUfGmAfAmUfUmUfCmCfUmAf UmGfUmAfUmUf | SEQ ID NO: 82 | CUUGAAUUUCCUAUGU AUU | SEQ ID NO: 42 |
| ETXS1239 | AfsAmsUfGmGfAmUfUmUfCmCfUmAf AmUfAmAfUmUf | SEQ ID NO: 83 | AAUGGAUUUCCUAAUA AUU | SEQ ID NO: 43 |
| ETXS1241 | UfsCmsAfGmUfAmUfUmUfUmGfGmAf GmGfUmGfUmCf | SEQ ID NO: 84 | UCAGUAUUUUGGAGGU GUC | SEQ ID NO: 44 |
| ETXS1243 | UfsGmsGfAmUfUmUfCmCfUmAfAmUf AmAfUmUfAmUf | SEQ ID NO: 85 | UGGAUUUCCUAAUAAU UAU | SEQ ID NO: 45 |
| ETXS1245 | UfsGmsAfAmUfUmUfCmCfUmAfUmGf UmAfUmUfUmUf | SEQ ID NO: 86 | UGAAUUUCCUAUGUAU UUU | SEQ ID NO: 46 |
| ETXS1247 | GfsCmsUfGmGfAmUfGmUfAmCfAmGf AmGfAmUfAmCf | SEQ ID NO: 87 | GCUGGAUGUACAGAGA UAC | SEQ ID NO: 47 |
| ETXS1249 | CfsCmsAfAmAfGmUfGmCfCmUfUmAf AmAfAmGfAmAf | SEQ ID NO: 88 | CCAAAGUGCCUUAAAA GAA | SEQ ID NO: 48 |
| ETXS1251 | UfsAmsUfGmUfAmAfAmCfUmUfGmAf AmUfUmUfCmCf | SEQ ID NO: 89 | UAUGUAAACUUGAAUU UCC | SEQ ID NO: 49 |
| ETXS1253 | GfsGmsCfAmCfAmUfUmUfCmCfGmUf UmGfCmAfAmUf | SEQ ID NO: 90 | GGCACAUUUCCGUUGC AAU | SEQ ID NO: 50 |
| ETXS1255 | AfsUmsGfUmAfAmAfCmUfUmGfAmAf UmUfUmCfCmUf | SEQ ID NO: 91 | AUGUAAACUUGAAUUU CCU | SEQ ID NO: 51 |
| ETXS1257 | AfsUmsGfGmAfUmUfUmCfCmUfAmAf UmAfAmUfUmAf | SEQ ID NO: 92 | AUGGAUUUCCUAAUAA UUA | SEQ ID NO: 52 |
| ETXS1259 | UfsGmsUfCmUfCmUfGmCfUmCfUmAf AmGfUmAfAmAf | SEQ ID NO: 93 | UGUCUCUGCUCUAAGU AAA | SEQ ID NO: 53 |
| ETXS1261 | CfsAmsAfAmGfUmGfCmCfUmUfAmAf AmAfGmAfAmAf | SEQ ID NO: 94 | CAAAGUGCCUUAAAAG AAA | SEQ ID NO: 54 |
| ETXS1263 | UfsGmsAfAmUfGmUfGmCfCmUfUmUf UmAfAmUfUmAf | SEQ ID NO: 95 | UGAAUGUGCCUUUUAA UUA | SEQ ID NO: 55 |
| ETXS1265 | AfsCmsUfUmGfAmAfUmUfUmCfCmUf AmUfGmUfAmUf | SEQ ID NO: 96 | ACUUGAAUUUCCUAUG UAU | SEQ ID NO: 56 |
| ETXS1267 | CfsUmsGfAmCfUmUfUmUfCmCfAmAf AmGfUmGfCmCf | SEQ ID NO: 97 | CUGACUUUUCCAAAGU GCC | SEQ ID NO: 57 |
| ETXS1269 | CfsAmsAfUmGfGmAfUmUfUmCfCmUf AmAfUmAfAmUf | SEQ ID NO: 98 | CAAUGGAUUUCCUAAU AAU | SEQ ID NO: 58 |
| ETXS1271 | UfsUmsCfAmGfUmAfUmUfUmUfGmGf AmGfGmUfGmUf | SEQ ID NO: 99 | UUCAGUAUUUUGGAGG UGU | SEQ ID NO: 59 |
| ETXS1273 | CfsCmsUfGmAfCmUfUmUfUmCfCmAf AmAfGmUfGmCf | SEQ ID NO: 100 | CCUGACUUUUCCAAAG UGC | SEQ ID NO: 60 |
| ETXS1275 | GfsGmsAfUmUfUmCfCmUfAmAfUmAf AmUfUmAfUmUf | SEQ ID NO: 101 | GGAUUUCCUAAUAAUU AUU | SEQ ID NO: 61 |
| ETXS1037 | AmsAmsCmUmUmGmAfAmUfUfUfCm CmUmAmUmGmUmAmUmUm | SEQ ID NO: 618 | AACUUGAAUUUCCUAU GUAUU | SEQ ID NO: 320 |
| ETXS1039 | UmsCmsAmAmUmGmGfAmUfUfUfCm CmUmAmAmUmAmAmUmUm | SEQ ID NO: 619 | UCAAUGGAUUUCCUAA UAAUU | SEQ ID NO: 337 |
| ETXS1041 | GmsUmsUmCmAmGmUfAmUfUfUfUm GmGmAmGmGmUmGmUmCm | SEQ ID NO: 620 | GUUCAGUAUUUUGGAG GUGUC | SEQ ID NO: 385 |
| ETXS1043 | AmsAmsUmGmGmAmUfUmUfCfCfUm AmAmUmAmAmUmUmAmUm | SEQ ID NO: 621 | AAUGGAUUUCCUAAUA AUUAU | SEQ ID NO: 311 |
| ETXS1045 | CmsUmsUmGmAmAmUfUmUfCfCfUm AmUmGmUmAmUmUmUmUm | SEQ ID NO: 514 | CUUGAAUUUCCUAUGU AUUUU | SEQ ID NO: 305 |

TABLE 4-continued

| Sense strand ID | Modified Second (Sense) Strand 5' → 3' | SEQ ID NO (SS - mod) | Underlying Base Sequence 5' → 3' (Shown as an Unmodified Nucleoside Sequence) | SEQ ID NO (SS - unmod) |
|---|---|---|---|---|
| ETXS1047 | GmsUmsGmCmUmGmGfAmUfGfUfAm CmAmGmAmGmAmUmAmCm | SEQ ID NO: 515 | GUGCUGGAUGUACAGA GAUAC | SEQ ID NO: 359 |
| ETXS1049 | UmsUmsCmCmAmAmAfGmUfGfCfCm UmUmAmAmAmGmAmAm | SEQ ID NO: 516 | UUCCAAAGUGCCUUAA AAGAA | SEQ ID NO: 340 |
| ETXS1051 | GmsCmsUmAmUmGmUfAmAfAfCfUm UmGmAmAmUmUmUmCmCm | SEQ ID NO: 517 | GCUAUGUAAACUUGAA UUUCC | SEQ ID NO: 322 |
| ETXS1053 | AmsCmsGmGmCmAmCfAmUfUfUfCm CmGmUmUmGmCmAmAmUm | SEQ ID NO: 518 | ACGGCACAUUUCCGUU GCAAU | SEQ ID NO: 334 |
| ETXS1055 | CmsUmsAmUmGmUmAfAmAfCfUfUm GmAmAmUmUmUmCmCmUm | SEQ ID NO: 519 | CUAUGUAAACUUGAAU UUCCU | SEQ ID NO: 327 |
| ETXS1057 | CmsAmsAmUmGmGmAfUmUfUfCfCm UmAmAmUmAmAmUmUmAm | SEQ ID NO: 520 | CAAUGGAUUUCCUAAU AAUUA | SEQ ID NO: 316 |
| ETXS1059 | GmsGmsUmGmUmCmUfCmUfGfCfUm CmUmAmAmGmUmAmAmAm | SEQ ID NO: 521 | GGUGUCUCUGCUCUAA GUAAA | SEQ ID NO: 323 |
| ETXS1061 | UmsCmsCmAmAmAmGfUmGfCfCfUm UmAmAmAmAmGmAmAmAm | SEQ ID NO: 522 | UCCAAAGUGCCUUAAA AGAAA | SEQ ID NO: 326 |
| ETXS1063 | CmsAmsUmGmAmAmUfGmUfGfCfCm UmUmUmUmAmAmUmUmAm | SEQ ID NO: 523 | CAUGAAUGUGCCUUUU AAUUA | SEQ ID NO: 324 |
| ETXS1065 | AmsAmsAmCmUmUmGfAmAfUfUfUm CmCmUmAmUmGmUmAmUm | SEQ ID NO: 524 | AAACUUGAAUUUCCUA UGUAU | SEQ ID NO: 302 |
| ETXS1067 | UmsCmsCmUmGmAmCfUmUfUfUfCm CmAmAmAmGmUmGmCmCm | SEQ ID NO: 525 | UCCUGACUUUUCCAAA GUGCC | SEQ ID NO: 369 |
| ETXS1069 | AmsUmsCmAmAmUmGfGmAfUfUfUm CmCmUmAmAmUmAmAmUm | SEQ ID NO: 526 | AUCAAUGGAUUUCCUA AUAAU | SEQ ID NO: 319 |
| ETXS1071 | UmsGmsUmUmCmAmGfUmAfUfUfUm UmGmGmAmGmGmUmGmUm | SEQ ID NO: 527 | UGUUCAGUAUUUUGGA GGUGU | SEQ ID NO: 362 |
| ETXS1073 | AmsUmsCmCmUmGmAfCmUfUfUfUm CmCmAmAmAmGmUmGmCm | SEQ ID NO: 528 | AUCCUGACUUUUCCAA AGUGC | SEQ ID NO: 378 |
| ETXS1075 | AmsUmsGmGmAmUmUfUmCfCfUfAm AmUmAmAmUmUmAmUmUm | SEQ ID NO: 529 | AUGGAUUUCCUAAUAA UUAUU | SEQ ID NO: 312 |
| ETXS1077 | AmsGmsCmAmUmGmAfAmUfGfUfGm CmCmUmUmUmUmAmAmUm | SEQ ID NO: 530 | AGCAUGAAUGUGCCUU UUAAU | SEQ ID NO: 329 |
| ETXS1079 | UmsGmsUmCmUmCmUfGmCfUfCfUm AmAmGmUmAmAmAmCmAm | SEQ ID NO: 531 | UGUCUCUGCUCUAAGU AAACA | SEQ ID NO: 342 |
| ETXS1081 | AmsUmsGmUmUmCmAfGmUfAfUfUm UmUmGmGmAmGmGmUmGm | SEQ ID NO: 532 | AUGUUCAGUAUUUUGG AGGUG | SEQ ID NO: 393 |
| ETXS1083 | GmsAmsUmCmCmUmGfAmCfUfUfUm UmCmCmAmAmAmGmUmGm | SEQ ID NO: 533 | GAUCCUGACUUUUCCA AAGUG | SEQ ID NO: 354 |
| ETXS1085 | AmsUmsGmCmUmAmUfGmUfAfAfAm CmUmUmGmAmAmUmUmUm | SEQ ID NO: 534 | AUGCUAUGUAAACUUG AAUUU | SEQ ID NO: 308 |
| ETXS1087 | GmsCmsUmCmUmAmAfGmUfAfAfAm CmAmAmCmAmGmUmUmUm | SEQ ID NO: 535 | GCUCUAAGUAAACAAC AGUUU | SEQ ID NO: 360 |
| ETXS1089 | GmsCmsUmGmGmAmUfGmUfAfCfAm GmAmGmAmUmAmCmCmCm | SEQ ID NO: 536 | GCUGGAUGUACAGAGA UACCC | SEQ ID NO: 381 |
| ETXS1091 | UmsCmsUmCmUmGmCfUmCfUfAfAm GmUmAmAmAmCmAmAmCm | SEQ ID NO: 537 | UCUCUGCUCUAAGUAA ACAAC | SEQ ID NO: 347 |
| ETXS1093 | UmsAmsUmGmUmAmAfAmCfUfUfGm AmAmUmUmUmCmCmUmAm | SEQ ID NO: 538 | UAUGUAAACUUGAAUU UCCUA | SEQ ID NO: 303 |
| ETXS1095 | UmsAmsCmCmCmAmAfAmUfCfAfCm AmGmUmGmGmAmCmAmUm | SEQ ID NO: 539 | UACCCAAAUCACAGUG GACAU | SEQ ID NO: 351 |

TABLE 4-continued

| Sense strand ID | Modified Second (Sense) Strand 5' → 3' | SEQ ID NO (SS - mod) | Underlying Base Sequence 5' → 3' (Shown as an Unmodified Nucleoside Sequence) | SEQ ID NO (SS - unmod) |
|---|---|---|---|---|
| ETXS1097 | UmsCmsCmUmCmAmGfAmGfGfUfUm UmGmAmCmCmGmAmAmUm | SEQ ID NO: 540 | UCCUCAGAGGUUUGAC CGAAU | SEQ ID NO: 315 |
| ETXS1099 | AmsCmsUmUmGmAmAfUmUfUfCfCm UmAmUmGmUmAmUmUmUm | SEQ ID NO: 541 | ACUUGAAUUUCCUAUG UAUUU | SEQ ID NO: 306 |
| ETXS1101 | AmsUmsGmAmAmUmGfUmGfCfCfUm UmUmUmAmAmUmUmAmGm | SEQ ID NO: 542 | AUGAAUGUGCCUUUUA AUUAG | SEQ ID NO: 349 |
| ETXS1103 | GmsCmsGmUmCmUmCfUmCfCfUfCm AmCmAmAmGmGmUmGmGm | SEQ ID NO: 543 | GCGUCUCUCCUCACAA GGUGG | SEQ ID NO: 370 |
| ETXS1105 | AmsUmsAmCmCmCmAfAmAfUfCfAm CmAmGmUmGmGmAmCmAm | SEQ ID NO: 544 | AUACCCAAAUCACAGU GGACA | SEQ ID NO: 379 |
| ETXS1107 | UmsAmsAmAmCmUmUfGmAfAfUfUm UmCmCmUmAmUmGmUmAm | SEQ ID NO: 545 | UAAACUUGAAUUUCCU AUGUA | SEQ ID NO: 310 |
| ETXS1109 | GmsUmsCmUmGmAmUfUmUfCfUfGm AmAmUmGmUmAmAmAmGm | SEQ ID NO: 546 | GUCUGAUUUCUGAAUG UAAAG | SEQ ID NO: 333 |
| ETXS1111 | GmsGmsAmUmUmUmCfCmUfAfAfUm AmAmUmUmAmUmUmGmGm | SEQ ID NO: 547 | GGAUUUCCUAAUAAUU AUUGG | SEQ ID NO: 371 |
| ETXS1113 | AmsUmsUmCmCmGmCfAmAfCfCfGm GmCmAmGmGmAmGmCmAm | SEQ ID NO: 548 | AUUCCGCAACCGGCAG GAGCA | SEQ ID NO: 380 |
| ETXS1115 | GmsUmsCmUmCmUmGfCmUfCfUfAm AmGmUmAmAmAmCmAmAm | SEQ ID NO: 549 | GUCUCUGCUCUAAGUA AACAA | SEQ ID NO: 353 |
| ETXS1117 | CmsUmsGmCmUmCmUfAmAfGfUfAm AmAmCmAmAmCmAmGmUm | SEQ ID NO: 550 | CUGCUCUAAGUAAACA ACAGU | SEQ ID NO: 365 |
| ETXS1119 | UmsUmsUmUmCmCmAfAmAfGfUfGm CmCmUmUmAmAmAmAmGm | SEQ ID NO: 551 | UUUUCCAAAGUGCCUU AAAAG | SEQ ID NO: 341 |
| ETXS1121 | UmsAmsUmGmUmUmCfAmGfUfAfUm UmUmUmGmGmAmGmGmUm | SEQ ID NO: 552 | UAUGUUCAGUAUUUUG GAGGU | SEQ ID NO: 356 |
| ETXS1123 | AmsCmsAmGmUmGmGfAmCfAfUfCm GmGmGmAmCmAmCmCmGm | SEQ ID NO: 553 | ACAGUGGACAUCGGGA CACCG | SEQ ID NO: 390 |
| ETXS1125 | AmsUmsUmUmCmCmUfAmAfUfAfAm UmUmAmUmUmGmGmGmGm | SEQ ID NO: 554 | AUUUCCUAAUAAUUAU UGGGG | SEQ ID NO: 389 |
| ETXS1127 | AmsCmsCmCmAmAmAfUmCfAfCfAm GmUmGmGmAmCmAmUmCm | SEQ ID NO: 555 | ACCCAAAUCACAGUGG ACAUC | SEQ ID NO: 388 |
| ETXS1129 | UmsUmsUmGmGmAmGfGmUfGfUfCm UmCmUmGmCmUmCmUmAm | SEQ ID NO: 556 | UUUGGAGGUGUCUCUG CUCUA | SEQ ID NO: 346 |
| ETXS1131 | CmsCmsAmAmAmUmCfAmCfAfGfUm GmGmAmCmAmUmCmGmGm | SEQ ID NO: 557 | CCAAAUCACAGUGGAC AUCGG | SEQ ID NO: 364 |
| ETXS1133 | UmsUmsUmCmCmAmAfAmGfUfGfCm CmUmUmAmAmAmAmGmAm | SEQ ID NO: 558 | UUUCCAAAGUGCCUUA AAAGA | SEQ ID NO: 367 |
| ETXS1135 | GmsAmsUmUmUmCmCfUmAfAfUfAm AmUmUmAmUmUmGmGmGm | SEQ ID NO: 559 | GAUUUCCUAAUAAUUA UUGGG | SEQ ID NO: 335 |
| ETXS1137 | UmsAmsUmAmCmCmCfAmAfAfUfCm AmCmAmGmUmGmGmAmCm | SEQ ID NO: 560 | UAUACCCAAAUCACAG UGGAC | SEQ ID NO: 373 |
| ETXS1139 | GmsGmsUmUmUmGmAfAmCfUfCfAm CmUmCmAmCmCmUmAmCm | SEQ ID NO: 561 | GGUUUGAACUCACUCA CCUAC | SEQ ID NO: 345 |
| ETXS1141 | GmsGmsAmGmGmUmGfUmCfUfCfUm GmCmUmCmUmAmAmGmUm | SEQ ID NO: 562 | GGAGGUGUCUCUGCUC UAAGU | SEQ ID NO: 332 |
| ETXS1143 | UmsGmsCmGmUmCmUfCmUfCfCfUm CmAmCmAmAmGmGmUmGm | SEQ ID NO: 563 | UGCGUCUCUCCUCACA AGGUG | SEQ ID NO: 401 |
| ETXS1145 | AmsGmsGmAmGmAmAfGmAfUfGfAm UmGmAmCmAmUmUmUmUm | SEQ ID NO: 564 | AGGAGAAGAUGAUGAC AUUUU | SEQ ID NO: 331 |

TABLE 4-continued

| Sense strand ID | Modified Second (Sense) Strand 5' → 3' | SEQ ID NO (SS - mod) | Underlying Base Sequence 5' → 3' (Shown as an Unmodified Nucleoside Sequence) | SEQ ID NO (SS - unmod) |
|---|---|---|---|---|
| ETXS1147 | UmsGmsGmAmGmGmUfGmUfCfUfCm UmGmCmUmCmUmAmAmGm | SEQ ID NO: 565 | UGGAGGUGUCUCUGCU CUAAG | SEQ ID NO: 366 |
| ETXS1149 | UmsUmsAmUmUmGmGfGmGfCfUfGm GmGmGmAmGmGmAmGmAm | SEQ ID NO: 566 | UUAUUGGGGCUGGGGA GGAGA | SEQ ID NO: 376 |
| ETXS1151 | CmsCmsUmGmAmCmUfUmUfUfCfCm AmAmAmGmUmGmCmCmUm | SEQ ID NO: 567 | CCUGACUUUUCCAAAG UGCCU | SEQ ID NO: 343 |
| ETXS1153 | GmsGmsCmAmCmAmUfUmUfCfCfGm UmUmGmCmAmAmUmGmGm | SEQ ID NO: 568 | GGCACAUUUCCGUUGC AAUGG | SEQ ID NO: 372 |
| ETXS1155 | UmsGmsCmUmCmUmAfAmGfUfAfAm AmCmAmAmCmAmGmUmUm | SEQ ID NO: 569 | UGCUCUAAGUAAACAA CAGUU | SEQ ID NO: 321 |
| ETXS1157 | UmsUmsGmGmAmGmGfUmGfUfCfUm CmUmGmCmUmCmUmAmAm | SEQ ID NO: 570 | UUGGAGGUGUCUCUGC UCUAA | SEQ ID NO: 314 |
| ETXS1159 | UmsGmsCmUmAmUmGfUmAfAfAfCm UmUmGmAmAmUmUmUmCm | SEQ ID NO: 571 | UGCUAUGUAAACUUGA AUUUC | SEQ ID NO: 318 |
| ETXS1161 | UmsGmsGmAmUmUmUfCmCfUfAfAm UmAmAmUmUmAmUmUmGm | SEQ ID NO: 572 | UGGAUUUCCUAAUAAU UAUUG | SEQ ID NO: 357 |
| ETXS1163 | AmsUmsUmAmUmUmGfGmGfGfCfUm GmGmGmGmAmGmGmAmGm | SEQ ID NO: 573 | AUUAUUGGGGCUGGGG AGGAG | SEQ ID NO: 396 |
| ETXS1165 | CmsUmsUmUmUmCmCfAmAfAfGfUm GmCmCmUmUmAmAmAmAm | SEQ ID NO: 574 | CUUUUCCAAAGUGCCU UAAAA | SEQ ID NO: 317 |
| ETXS1167 | UmsAmsUmUmGmGmGfGmCfUfGfGm GmGmAmGmGmAmGmAmAm | SEQ ID NO: 575 | UAUUGGGGCUGGGGAG GAGAA | SEQ ID NO: 386 |
| ETXS1169 | GmsAmsCmAmUmCmGfGmGfAfCfAm CmCmGmAmGmCmUmAmGm | SEQ ID NO: 576 | GACAUCGGGACACCGA GCUAG | SEQ ID NO: 394 |
| ETXS1171 | UmsUmsCmAmGmUmAfUmUfUfUfGm GmAmGmGmUmGmUmCmUm | SEQ ID NO: 577 | UUCAGUAUUUUGGAGG UGUCU | SEQ ID NO: 336 |
| ETXS1173 | GmsAmsGmGmUmGmUfCmUfCfUfGm CmUmCmUmAmAmGmUmAm | SEQ ID NO: 578 | GAGGUGUCUCUGCUCU AAGUA | SEQ ID NO: 358 |
| ETXS1175 | UmsGmsGmUmUmUmGfAmAfCfUfCm AmCmUmCmAmCmCmUmAm | SEQ ID NO: 579 | UGGUUUGAACUCACUC ACCUA | SEQ ID NO: 339 |
| ETXS1177 | UmsCmsUmGmAmUmUfUmCfUfGfAm AmUmGmUmAmAmAmGmUm | SEQ ID NO: 580 | UCUGAUUUCUGAAUGU AAAGU | SEQ ID NO: 309 |
| ETXS1179 | UmsGmsUmAmAmAmCfUmUfGfAfAm UmUmUmCmCmUmAmUmGm | SEQ ID NO: 581 | UGUAAACUUGAAUUUC CUAUG | SEQ ID NO: 304 |
| ETXS1181 | GmsUmsGmUmCmUmCfUmGfCfUfCm UmAmAmGmUmAmAmAmCm | SEQ ID NO: 582 | GUGUCUCUGCUCUAAG UAAAC | SEQ ID NO: 330 |
| ETXS1183 | CmsUmsGmCmGmUmCfUmCfUfCfCm UmCmAmCmAmAmGmGmUm | SEQ ID NO: 583 | CUGCGUCUCUCCUCAC AAGGU | SEQ ID NO: 382 |
| ETXS1185 | UmsUmsAmUmGmUmUfCmAfGfUfAm UmUmUmUmGmGmAmGmGm | SEQ ID NO: 584 | UUAUGUUCAGUAUUUU GGAGG | SEQ ID NO: 387 |
| ETXS1187 | CmsAmsCmAmGmUmGfGmAfCfAfUm CmGmGmGmAmCmAmCmCm | SEQ ID NO: 585 | CACAGUGGACAUCGGG ACACC | SEQ ID NO: 352 |
| ETXS1189 | UmsCmsUmGmCmUmCfUmAfAfGfUm AmAmAmCmAmAmCmAmGm | SEQ ID NO: 586 | UCUGCUCUAAGUAAAC AACAG | SEQ ID NO: 361 |
| ETXS1191 | CmsGmsGmCmAmCmAfUmUfUfCfCm GmUmUmGmCmAmAmUmGm | SEQ ID NO: 587 | CGGCACAUUUCCGUUG CAAUG | SEQ ID NO: 350 |
| ETXS1193 | UmsCmsAmGmUmAmUfUmUfUfGfGm AmGmGmUmGmUmCmUmCm | SEQ ID NO: 588 | UCAGUAUUUUGGAGGU GUCUC | SEQ ID NO: 374 |
| ETXS1195 | GmsCmsAmCmAmUmUfUmCfCfGfUm UmGmCmAmAmUmGmGmAm | SEQ ID NO: 589 | GCACAUUUCCGUUGCA AUGGA | SEQ ID NO: 348 |

TABLE 4-continued

| Sense strand ID | Modified Second (Sense) Strand 5' → 3' | SEQ ID NO (SS - mod) | Underlying Base Sequence 5' → 3' (Shown as an Unmodified Nucleoside Sequence) | SEQ ID NO (SS - unmod) |
|---|---|---|---|---|
| ETXS1197 | CmsAmsUmGmCmUmAfUmGfUfAfAm AmCmUmUmGmAmAmUmUm | SEQ ID NO: 590 | CAUGCUAUGUAAACUU GAAUU | SEQ ID NO: 313 |
| ETXS1199 | AmsUmsCmCmUmCmAfGmAfGfGfUm UmUmGmAmCmCmGmAmAm | SEQ ID NO: 591 | AUCCUCAGAGGUUUGA CCGAA | SEQ ID NO: 338 |
| ETXS1201 | UmsCmsAmCmAmGmUfGmGfAfCfAm UmCmGmGmGmAmCmAmCm | SEQ ID NO: 592 | UCACAGUGGACAUCGG GACAC | SEQ ID NO: 400 |
| ETXS1203 | CmsUmsUmUmCmAmAfGmAfAfGfCm CmUmUmGmAmAmGmGmAm | SEQ ID NO: 593 | CUUUCAAGAAGCCUUG AAGGA | SEQ ID NO: 375 |
| ETXS1205 | AmsGmsGmUmGmUmCfUmCfUfGfCm UmCmUmAmAmGmUmAmAm | SEQ ID NO: 594 | AGGUGUCUCUGCUCUA AGUAA | SEQ ID NO: 325 |
| ETXS1207 | UmsUmsUmUmGmGmAfGmGfUfGfUm CmUmCmUmGmCmUmCmUm | SEQ ID NO: 595 | UUUUGGAGGUGUCUCU GCUCU | SEQ ID NO: 363 |
| ETXS1209 | GmsCmsAmUmGmAmAfUmGfUfGfCm CmUmUmUmUmAmAmUmUm | SEQ ID NO: 596 | GCAUGAAUGUGCCUUU UAAUU | SEQ ID NO: 355 |
| ETXS1211 | AmsCmsAmUmCmGmGfGmAfCfAfCm CmGmAmGmCmUmAmGmCm | SEQ ID NO: 597 | ACAUCGGGACACCGAG CUAGC | SEQ ID NO: 377 |
| ETXS1213 | AmsCmsUmGmCmGmUfCmUfCfUfCm CmUmCmAmCmAmAmGmGm | SEQ ID NO: 598 | ACUGCGUCUCUCCUCA CAAGG | SEQ ID NO: 398 |
| ETXS1215 | GmsUmsAmUmAmCmCfCmAfAfAfUm CmAmCmAmGmUmGmGmAm | SEQ ID NO: 599 | GUAUACCCAAAUCACA GUGGA | SEQ ID NO: 391 |
| ETXS1217 | UmsGmsCmUmGmGmAfUmGfUfAfCm AmGmAmGmAmUmAmCmCm | SEQ ID NO: 600 | UGCUGGAUGUACAGAG AUACC | SEQ ID NO: 368 |
| ETXS1219 | AmsUmsGmUmAmAmAfCmUfUfGfAm AmUmUmUmCmCmUmAmUm | SEQ ID NO: 601 | AUGUAAACUUGAAUUU CCUAU | SEQ ID NO: 307 |
| ETXS1221 | GmsGmsGmGmCmUmGfGmGfGfAfGm GmAmGmAmAmGmAmUmGm | SEQ ID NO: 602 | GGGGCUGGGGAGGAGA AGAUG | SEQ ID NO: 397 |
| ETXS1223 | CmsUmsCmUmGmCmUfCmUfAfAfGm UmAmAmAmCmAmAmCmAm | SEQ ID NO: 603 | CUCUGCUCUAAGUAAA CAACA | SEQ ID NO: 384 |
| ETXS1225 | UmsGmsGmGmGmCmUfGmGfGfGfAm GmGmAmGmAmAmGmAmUm | SEQ ID NO: 604 | UGGGGCUGGGGAGGAG AAGAU | SEQ ID NO: 392 |
| ETXS1227 | AmsAmsUmCmAmCmAfGmUfGfGfAm CmAmUmCmGmGmGmAmCm | SEQ ID NO: 605 | AAUCACAGUGGACAUC GGGAC | SEQ ID NO: 383 |
| ETXS1229 | AmsGmsUmGmGmAmCfAmUfCfGfGm GmAmCmAmCmCmGmAmGm | SEQ ID NO: 606 | AGUGGACAUCGGGACA CCGAG | SEQ ID NO: 395 |
| ETXS1231 | AmsAmsUmAmAmUmUfAmUfUfGfGm GmGmCmUmGmGmGmGmAm | SEQ ID NO: 607 | AAUAAUUAUUGGGGCU GGGGA | SEQ ID NO: 399 |
| ETXS1233 | CmsAmsGmUmAmUmUfUmUfGfGfAm GmGmUmGmUmCmUmCmUm | SEQ ID NO: 608 | CAGUAUUUUGGAGGUG UCUCU | SEQ ID NO: 328 |
| ETXS1235 | AmsUmsUmUmUmGmGfAmGfGfUfGm UmCmUmCmUmGmCmUmCm | SEQ ID NO: 609 | AUUUUGGAGGUGUCUC UGCUC | SEQ ID NO: 344 |
| ETXS2399 | iaiaAmsAmsAmCmUmUmGfAmAfUfUf UfCmCmUmAmUmGmUmAmUm | SEQ ID NO: 610 | AAACUUGAAUUUCCUA UGUAU | SEQ ID NO: 302 |
| ETXS2401 | iaiaAmsAmsAmCmUmUmGmAmAfUfUf UmCmCmUmAmUmGmUmAmUm | SEQ ID NO: 611 | AAACUUGAAUUUCCUA UGUAU | SEQ ID NO: 302 |
| ETXS2405 | iaiaCmsUmsUmGmAmAmUfUmUfCfCf UfAmUmGmUmAmUmUmUmUm | SEQ ID NO: 612 | CUUGAAUUUCCUAUGU AUUUU | SEQ ID NO: 305 |
| ETXS2407 | iaiaCmsUmsUmGmAmAmUmUmUfCfCf UmAmUmGmUmAmUmUmUmUm | SEQ ID NO: 613 | CUUGAAUUUCCUAUGU AUUUU | SEQ ID NO: 305 |
| ETXS2423 | iaiaCmsUmsUmUmUmCmCfAmAfAfGf UfGmCmCmUmUmAmAmAmAm | SEQ ID NO: 614 | CUUUUCCAAAGUGCCU UAAAA | SEQ ID NO: 317 |

TABLE 4-continued

| Sense strand ID | Modified Second (Sense) Strand 5' → 3' | SEQ ID NO (SS - mod) | Underlying Base Sequence 5' → 3' (Shown as an Unmodified Nucleoside Sequence) | SEQ ID NO (SS - unmod) |
|---|---|---|---|---|
| ETXS2425 | iaiaCmsUmsUmUmUmCmCmAmAfAfGf UmGmCmCmUmUmAmAmAmAm | SEQ ID NO: 615 | CUUUUCCAAAGUGCCU UAAAA | SEQ ID NO: 317 |
| ETXS2429 | iaiaCmsAmsGmUmAmUmUfUmUfGfGf AfGmGmUmGmUmCmUmCmUm | SEQ ID NO: 616 | CAGUAUUUUGGAGGUG UCUCU | SEQ ID NO: 328 |
| ETXS2431 | iaiaCmsAmsGmUmAmUmUmUmUfGfGf AmGmGmUmGmUmCmUmCmUm | SEQ ID NO: 617 | CAGUAUUUUGGAGGUG UCUCU | SEQ ID NO: 328 |

As used herein, and in particular in Tables 3 and 4, the following abbreviations are used for modified nucleosides:

Am stands for 2'-O-methyl-adenosine, Cm stands for 2'-O-methyl-cytidine, Gm stands for 2'-O-methyl-guanosine, Um stands for 2'-O-methyl-uridine, Af stands for 2'-Fluoro-adenosine, Cf stands for 2'-Fluoro-cytidine, Gf stands for 2'-Fluoro-guanosine and Uf stands for 2'-Fluoro-uridine.

Furthermore, the letter "s" is used as abbreviation for a phosphorothioate linkage between two consecutive (modified) nucleosides. For example, the abbreviation "AmsAm" is used for two consecutive 2'-O-methyl-adenosine nucleosides that are linked via a 3'-5' phosphorothioate linkage. No abbreviation is used for nucleosides that are linked via a standard 3'-5' phosphodiester linkage. For example, the abbreviation "AmAm" is used for two consecutive 2'-O-methyl-adenosine nucleosides that are linked via a 3'-5' phosphodiester linkage.

In certain embodiments, the nucleic acid comprises a first strand that comprises, consists of, or consists essentially of a (modified) nucleoside sequence differing by 0 or 1 nucleosides from any one of SEQ ID NOs: 62-81 or SEQ ID NOs: 402-513;

and a second strand that comprises, consists of, or consists essentially of a (modified) nucleoside sequence differing by 0 or 1 nucleosides from any one of SEQ ID NOs: 82-101 or SEQ ID NOs: 514-621.

Preferred combinations of complementary modified antisense (first) and sense (second) strands are listed below in Table 5:

TABLE 5

| Duplex ID | First (Antisense) strand ID | Second (Sense) strand ID |
|---|---|---|
| ETXM619 | ETXS1238 | ETXS1237 |
| ETXM620 | ETXS1240 | ETXS1239 |
| ETXM621 | ETXS1242 | ETXS1241 |
| ETXM622 | ETXS1244 | ETXS1243 |
| ETXM623 | ETXS1246 | ETXS1245 |
| ETXM624 | ETXS1248 | ETXS1247 |
| ETXM625 | ETXS1250 | ETXS1249 |
| ETXM626 | ETXS1252 | ETXS1251 |
| ETXM627 | ETXS1254 | ETXS1253 |
| ETXM628 | ETXS1256 | ETXS1255 |
| ETXM629 | ETXS1258 | ETXS1257 |
| ETXM630 | ETXS1260 | ETXS1259 |
| ETXM631 | ETXS1262 | ETXS1261 |
| ETXM632 | ETXS1264 | ETXS1263 |
| ETXM633 | ETXS1266 | ETXS1265 |
| ETXM634 | ETXS1268 | ETXS1267 |
| ETXM635 | ETXS1270 | ETXS1269 |
| ETXM636 | ETXS1272 | ETXS1271 |
| ETXM637 | ETXS1274 | ETXS1273 |
| ETXM638 | ETXS1276 | ETXS1275 |
| ETXM519 | ETXS1038 | ETXS1037 |

TABLE 5-continued

| Duplex ID | First (Antisense) strand ID | Second (Sense) strand ID |
|---|---|---|
| ETXM520 | ETXS1040 | ETXS1039 |
| ETXM521 | ETXS1042 | ETXS1041 |
| ETXM522 | ETXS1044 | ETXS1043 |
| ETXM523 | ETXS1046 | ETXS1045 |
| ETXM524 | ETXS1048 | ETXS1047 |
| ETXM525 | ETXS1050 | ETXS1049 |
| ETXM526 | ETXS1052 | ETXS1051 |
| ETXM527 | ETXS1054 | ETXS1053 |
| ETXM528 | ETXS1056 | ETXS1055 |
| ETXM529 | ETXS1058 | ETXS1057 |
| ETXM530 | ETXS1060 | ETXS1059 |
| ETXM531 | ETXS1062 | ETXS1061 |
| ETXM532 | ETXS1064 | ETXS1063 |
| ETXM533 | ETXS1066 | ETXS1065 |
| ETXM534 | ETXS1068 | ETXS1067 |
| ETXM535 | ETXS1070 | ETXS1069 |
| ETXM536 | ETXS1072 | ETXS1071 |
| ETXM537 | ETXS1074 | ETXS1073 |
| ETXM538 | ETXS1076 | ETXS1075 |
| ETXM539 | ETXS1078 | ETXS1077 |
| ETXM540 | ETXS1080 | ETXS1079 |
| ETXM541 | ETXS1082 | ETXS1081 |
| ETXM542 | ETXS1084 | ETXS1083 |
| ETXM543 | ETXS1086 | ETXS1085 |
| ETXM544 | ETXS1088 | ETXS1087 |
| ETXM545 | ETXS1090 | ETXS1089 |
| ETXM546 | ETXS1092 | ETXS1091 |
| ETXM547 | ETXS1094 | ETXS1093 |
| ETXM548 | ETXS1096 | ETXS1095 |
| ETXM549 | ETXS1098 | ETXS1097 |
| ETXM550 | ETXS1100 | ETXS1099 |
| ETXM551 | ETXS1102 | ETXS1101 |
| ETXM552 | ETXS1104 | ETXS1103 |
| ETXM553 | ETXS1106 | ETXS1105 |
| ETXM554 | ETXS1108 | ETXS1107 |
| ETXM555 | ETXS1110 | ETXS1109 |
| ETXM556 | ETXS1112 | ETXS1111 |
| ETXM557 | ETXS1114 | ETXS1113 |
| ETXM558 | ETXS1116 | ETXS1115 |
| ETXM559 | ETXS1118 | ETXS1117 |
| ETXM560 | ETXS1120 | ETXS1119 |
| ETXM561 | ETXS1122 | ETXS1121 |
| ETXM562 | ETXS1124 | ETXS1123 |
| ETXM563 | ETXS1126 | ETXS1125 |
| ETXM564 | ETXS1128 | ETXS1127 |
| ETXM565 | ETXS1130 | ETXS1129 |
| ETXM566 | ETXS1132 | ETXS1131 |
| ETXM567 | ETXS1134 | ETXS1133 |
| ETXM568 | ETXS1136 | ETXS1135 |
| ETXM569 | ETXS1138 | ETXS1137 |
| ETXM570 | ETXS1140 | ETXS1139 |
| ETXM571 | ETXS1142 | ETXS1141 |
| ETXM572 | ETXS1144 | ETXS1143 |
| ETXM573 | ETXS1146 | ETXS1145 |
| ETXM574 | ETXS1148 | ETXS1147 |
| ETXM575 | ETXS1150 | ETXS1149 |
| ETXM576 | ETXS1152 | ETXS1151 |
| ETXM577 | ETXS1154 | ETXS1153 |
| ETXM578 | ETXS1156 | ETXS1155 |

TABLE 5-continued

| Duplex ID | First (Antisense) strand ID | Second (Sense) strand ID |
|---|---|---|
| ETXM579 | ETXS1158 | ETXS1157 |
| ETXM580 | ETXS1160 | ETXS1159 |
| ETXM581 | ETXS1162 | ETXS1161 |
| ETXM582 | ETXS1164 | ETXS1163 |
| ETXM583 | ETXS1166 | ETXS1165 |
| ETXM584 | ETXS1168 | ETXS1167 |
| ETXM585 | ETXS1170 | ETXS1169 |
| ETXM586 | ETXS1172 | ETXS1171 |
| ETXM587 | ETXS1174 | ETXS1173 |
| ETXM588 | ETXS1176 | ETXS1175 |
| ETXM589 | ETXS1178 | ETXS1177 |
| ETXM590 | ETXS1180 | ETXS1179 |
| ETXM591 | ETXS1182 | ETXS1181 |
| ETXM592 | ETXS1184 | ETXS1183 |
| ETXM593 | ETXS1186 | ETXS1185 |
| ETXM594 | ETXS1188 | ETXS1187 |
| ETXM595 | ETXS1190 | ETXS1189 |
| ETXM596 | ETXS1192 | ETXS1191 |
| ETXM597 | ETXS1194 | ETXS1193 |
| ETXM598 | ETXS1196 | ETXS1195 |
| ETXM599 | ETXS1198 | ETXS1197 |
| ETXM600 | ETXS1200 | ETXS1199 |
| ETXM601 | ETXS1202 | ETXS1201 |
| ETXM602 | ETXS1204 | ETXS1203 |
| ETXM603 | ETXS1206 | ETXS1205 |
| ETXM604 | ETXS1208 | ETXS1207 |
| ETXM605 | ETXS1210 | ETXS1209 |
| ETXM606 | ETXS1212 | ETXS1211 |
| ETXM607 | ETXS1214 | ETXS1213 |
| ETXM608 | ETXS1216 | ETXS1215 |
| ETXM609 | ETXS1218 | ETXS1217 |
| ETXM610 | ETXS1220 | ETXS1219 |
| ETXM611 | ETXS1222 | ETXS1221 |
| ETXM612 | ETXS1224 | ETXS1223 |
| ETXM613 | ETXS1226 | ETXS1225 |
| ETXM614 | ETXS1228 | ETXS1227 |
| ETXM615 | ETXS1230 | ETXS1229 |
| ETXM616 | ETXS1232 | ETXS1231 |
| ETXM617 | ETXS1234 | ETXS1233 |
| ETXM618 | ETXS1236 | ETXS1235 |
| ETXM1200 | ETXS2400 | ETXS2399 |
| ETXM1201 | ETXS2402 | ETXS2401 |
| ETXM1203 | ETXS2406 | ETXS2405 |
| ETXM1204 | ETXS2408 | ETXS2407 |
| ETXM1212 | ETXS2424 | ETXS2423 |
| ETXM1213 | ETXS2426 | ETXS2425 |
| ETXM1215 | ETXS2430 | ETXS2429 |
| ETXM1216 | ETXS2432 | ETXS2431 |
| ETXM1217 | ETXS2434 | ETXS2401 |
| ETXM1218 | ETXS2436 | ETXS2407 |
| ETXM1219 | ETXS2438 | ETXS2425 |
| ETXM1220 | ETXS2440 | ETXS2431 |

In a particularly preferred embodiment, the invention relates to a nucleic acid comprising first and second strands that comprise, consist of, or consist essentially of a nucleoside sequence differing by 0 or 1 nucleosides from any one of the following first and second sequences:

| Modified first strand | Modified second strand |
|---|---|
| SEQ ID NO: 502 (ETXS2400) | SEQ ID NO: 610 (ETXS2399) |
| SEQ ID NO: 503 (ETXS2402) | SEQ ID NO: 611 (ETXS2401) |
| SEQ ID NO: 504 (ETXS2406) | SEQ ID NO: 612 (ETXS2405) |
| SEQ ID NO: 505 (ETXS2408) | SEQ ID NO: 613 (ETXS2407) |
| SEQ ID NO: 506 (ETXS2424) | SEQ ID NO: 614 (ETXS2423) |
| SEQ ID NO: 507 (ETXS2426) | SEQ ID NO: 615 (ETXS2425) |
| SEQ ID NO: 508 (ETXS2430) | SEQ ID NO: 616 (ETXS2429) |
| SEQ ID NO: 509 (ETXS2432) | SEQ ID NO: 617 (ETXS2431) |
| SEQ ID NO: 510 (ETXS2434) | SEQ ID NO: 611 (ETXS2401) |
| SEQ ID NO: 511 (ETXS2436) | SEQ ID NO: 613 (ETXS2407) |
| SEQ ID NO: 512 (ETXS2438) | SEQ ID NO: 615 (ETXS2425) |
| SEQ ID NO: 513 (ETXS2440) | SEQ ID NO: 617 (ETXS2431) |

In case of ambiguity between the sequences in this specification and the sequences in the attached sequence listing, the sequences provided herein are considered to be the correct sequences.

Abasic Nucleotides

In certain embodiments, there are 1, e.g. 2, e.g. 3, e.g. 4 or more abasic nucleosides present in nucleic acids according to the invention. Abasic nucleosides are modified nucleosides because they lack the base normally seen at position 1 of the sugar moiety. Typically, there will be a hydrogen at position 1 of the sugar moiety of the abasic nucleosides present in a nucleic acid according to the present invention.

The abasic nucleosides are in the terminal region of the second strand, preferably located within the terminal 5 nucleosides of the end of the strand. The terminal region may be the terminal 5 nucleosides, which includes abasic nucleosides.

The second strand may comprise, as preferred features (which are all specifically contemplated in combination unless mutually exclusive):

- 2, or more than 2, abasic nucleosides in a terminal region of the second strand; and/or
- 2, or more than 2, abasic nucleosides in either the 5' or 3' terminal region of the second strand; and/or
- 2, or more than 2, abasic nucleosides in either the 5' or 3' terminal region of the second strand, wherein the abasic nucleosides are present in an overhang as herein described; and/or
- 2, or more than 2, consecutive abasic nucleosides in a terminal region of the second strand, wherein preferably one such abasic nucleosides is a terminal nucleosides; and/or
- 2, or more than 2, consecutive abasic nucleosides in either the 5' or 3' terminal region of the second strand, wherein preferably one such abasic nucleosides is a terminal nucleosides in either the 5' or 3' terminal region of the second strand; and/or
- a reversed internucleoside linkage connects at least one abasic nucleoside to an adjacent basic nucleoside in a terminal region of the second strand; and/or
- a reversed internucleoside linkage connects at least one abasic nucleoside to an adjacent basic nucleoside in either the 5' or 3' terminal region of the second strand; and/or
- an abasic nucleoside as the penultimate nucleoside which is connected via the reversed linkage to the nucleoside which is not the terminal nucleoside (called the antepenultimate nucleoside herein); and/or
- abasic nucleosides as the 2 terminal nucleosides connected via a 5'-3' linkage when reading the strand in the direction towards the terminus comprising the terminal nucleosides;
- abasic nucleosides as the 2 terminal nucleosides connected via a 3'-5' linkage when reading the strand in the direction towards the terminus comprising the terminal nucleosides;
- abasic nucleosides as the terminal 2 positions, wherein the penultimate nucleoside is connected via the reversed linkage to the antepenultimate nucleoside, and wherein the reversed linkage is a 5-5' reversed linkage or a 3'-3' reversed linkage;

abasic nucleosides as the terminal 2 positions, wherein the penultimate nucleoside is connected via the reversed linkage to the antepenultimate nucleoside, and wherein either (1) the reversed linkage is a 5-5' reversed linkage and the linkage between the terminal and penultimate abasic nucleosides is 3'5' when reading towards the terminus comprising the terminal and penultimate abasic nucleosides; or (2) the reversed linkage is a 3-3' reversed linkage and the linkage between the terminal and penultimate abasic nucleosides is 5'3' when reading towards the terminus comprising the terminal and penultimate abasic nucleosides.

Preferably there is an abasic nucleoside at the terminus of the second strand.

Preferably there are 2 or at least 2 abasic nucleosides in the terminal region of the second strand, preferably at the terminal and penultimate positions.

Preferably 2 or more abasic nucleosides are consecutive, for example all abasic nucleosides may be consecutive. For example, the terminal 1 or terminal 2 or terminal 3 or terminal 4 nucleotides may be abasic nucleosides.

An abasic nucleoside may also be linked to an adjacent nucleoside through a 5'-3' phosphodiester linkage or reversed linkage unless there is only 1 abasic nucleoside at the terminus, in which case it will have a reversed linkage to the adjacent nucleoside.

A reversed linkage (which may also be referred to as an inverted linkage, which is also seen in the art), comprises either a 5'-5', a 3'-3', a 3'-2' or a 2'-3' phosphodiester linkage between the adjacent sugar moieties of the nucleosides.

Abasic nucleosides which are not terminal will have 2 phosphodiester bonds, one with each adjacent nucleoside, and these may be a reversed linkage or may be a 5'-3 phosphodiester bond or may be one of each.

A preferred embodiment comprises 2 abasic nucleosides at the terminal and penultimate positions of the second strand, and wherein the reversed internucleoside linkage is located between the penultimate (abasic) nucleoside and the antepenultimate nucleoside.

Preferably there are 2 abasic nucleosides at the terminal and penultimate positions of the second strand and the penultimate nucleoside is linked to the antepenultimate nucleoside through a reversed internucleoside linkage and is linked to the terminal nucleoside through a 5'-3' or 3'-5' phosphodiester linkage (reading in the direction of the terminus of the molecule).

Different preferred features are as follows:

The reversed internucleoside linkage is a 3'-3' reversed linkage. The reversed internucleoside linkage is at a terminal region which is distal to the 5' terminal phosphate of the second strand.

The reversed internucleoside linkage is a 5'-5' reversed linkage. The reversed internucleoside linkage is at a terminal region which is distal to the 3' terminal hydroxide of the second strand.

In certain embodiments, the second strand comprises 2 consecutive abasic nucleosides in the 5' terminal region of the second strand, wherein one such abasic nucleoside is a terminal nucleoside at the 5' terminal region of the second strand and the other abasic nucleoside is a penultimate nucleoside at the 5' terminal region of the second strand, wherein: (a) said penultimate abasic nucleoside is connected to an adjacent first basic nucleoside in an adjacent 5' near terminal region through a reversed internucleoside linkage; and (b) the reversed linkage is a 5-5' reversed linkage; and (c) the linkage between the terminal and penultimate abasic nucleosides is 3'-5' when reading towards the terminus comprising the terminal and penultimate abasic nucleosides. More typically, (i) the first strand and the second strand each has a length of 19 or 23 nucleosides; (ii) two phosphorothioate internucleoside linkages are respectively between three consecutive positions in said 5' near terminal region of the second strand, wherein a first phosphorothioate internucleoside linkage is present between said adjacent first basic nucleoside of (a) and an adjacent second basic nucleoside in said 5' near terminal region of the second strand, and a second phosphorothioate internucleoside linkage is present between said adjacent second basic nucleoside and an adjacent third basic nucleoside in said 5' near terminal region of the second strand; (iii) two phosphorothioate internucleoside linkages are respectively between three consecutive positions in both 5' and 3' terminal regions of the first strand, whereby a terminal nucleoside respectively at each of the 5' and 3' terminal regions of said first strand is each attached to a respective 5' and 3' adjacent penultimate nucleoside by a phosphorothioate internucleoside linkage, and each first 5' and 3' penultimate nucleoside is attached to a respective 5' and 3' adjacent antepenultimate nucleoside by a phosphorothioate internucleoside linkage; and (iv) the second strand of the nucleic acid is conjugated directly or indirectly to one or more ligand moieties at the 3' terminal region of the second strand.

Alternatively the second strand comprises 2 consecutive abasic nucleosides preferably in an overhang in the 3' terminal region of the second strand, wherein one such abasic nucleoside is a terminal nucleoside at the 3' terminal region of the second strand and the other abasic nucleoside is a penultimate nucleoside at the 3' terminal region of the second strand, wherein: (a) said penultimate abasic nucleoside is connected to an adjacent first basic nucleoside in an adjacent 3' near terminal region through a reversed internucleoside linkage; and (b) the reversed linkage is a 3-3' reversed linkage; and (c) the linkage between the terminal and penultimate abasic nucleosides is 5'-3' when reading towards the terminus comprising the terminal and penultimate abasic nucleosides. More typically, (i) the first strand and the second strand each has a length of 19 or 23 nucleosides; (ii) two phosphorothioate internucleoside linkages are respectively between three consecutive positions in said 3' near terminal region of the second strand, wherein a first phosphorothioate internucleoside linkage is present between said adjacent first basic nucleoside of (a) and an adjacent second basic nucleoside in said 3' near terminal region of the second strand, and a second phosphorothioate internucleoside linkage is present between said adjacent second basic nucleoside and an adjacent third basic nucleoside in said 3' near terminal region of the second strand; (iii) two phosphorothioate internucleoside linkages are respectively between three consecutive positions in both 5' and 3' terminal regions of the first strand, whereby a terminal nucleoside respectively at each of the 5' and 3' terminal regions of said first strand is each attached to a respective 5' and 3' adjacent penultimate nucleoside by a phosphorothioate internucleoside linkage, and each first 5' and 3' penultimate nucleoside is attached to a respective 5' and 3' adjacent antepenultimate nucleoside by a phosphorothioate internucleoside linkage; and (iv) the second strand of the nucleic acid is conjugated directly or indirectly to one or more ligand moieties at the 5' terminal region of the second strand.

Examples of the structures are as follows (where the specific RNA nucleosides shown are not limiting and could be any RNA nucleoside):

A A 3'-3' reversed bond (and also showing the 5'-3 direction of the last phosphodiester bond between the two abasic molecules reading towards the terminus of the molecule)

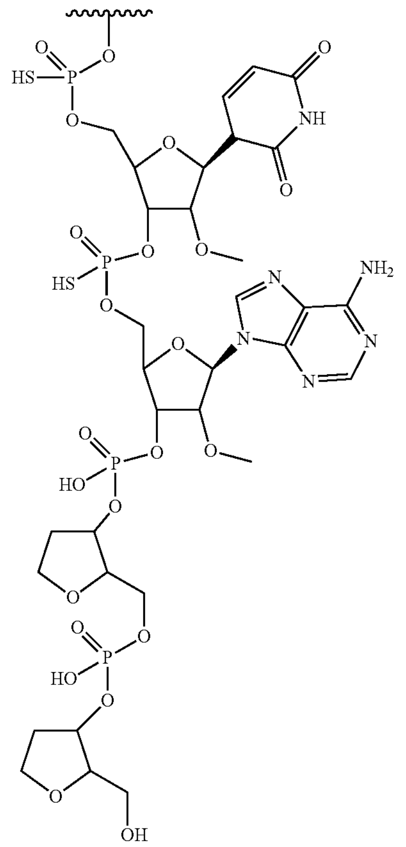 [SMILES: *OP(=O)(S)OCC1O[C@@H](C2C=CC(=O)NC2=O)C(OC)C1OP(=O)(S)OCC1O[C@@H](n2cnc3c(N)ncnc32)C(OC)C1OP(=O)(O)OC1CCOC1COP(=O)(O)OC1CCOC1CO]

B Illustrating a 5'-5' reversed bond (and also showing the 3'-5' direction of the last phosphodiester bond between the two abasic molecules reading towards the terminus of the molecule)

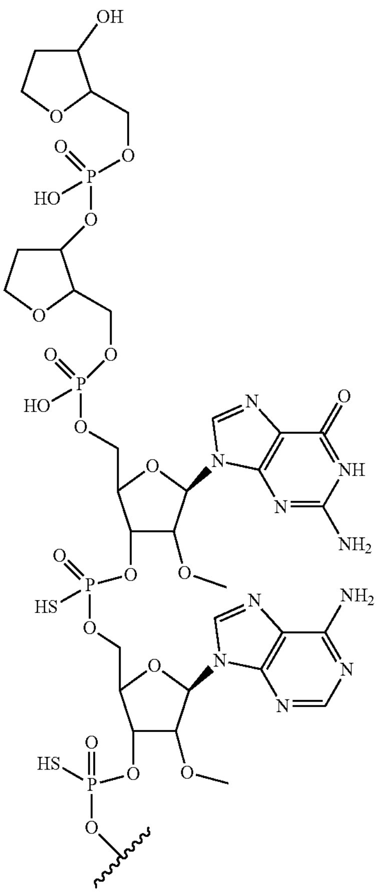

The abasic nucleoside or abasic nucleosides present in the nucleic acid are provided in the presence of a reversed internucleoside linkage or linkages, namely a 5'-5' or a 3'-3' reversed internucleoside linkage. A reversed linkage occurs as a result of a change of orientation of an adjacent nucleoside sugar, such that the sugar will have a 3'-5' orientation as opposed to the conventional 5'-3' orientation (with reference to the numbering of ring atoms on the nucleoside sugars). The abasic nucleoside or nucleosides as present in the nucleic acids of the invention preferably include such inverted nucleoside sugars.

In the case of a terminal nucleoside having an inverted orientation, then this will result in an "inverted" end configuration for the overall nucleic acid. Whilst certain structures drawn and referenced herein are represented using conventional 5'-3' direction (with reference to the numbering of ring atoms on the nucleoside sugars), it will be appreciated that the presence of a terminal nucleoside having a change of orientation and a proximal 3'-3' reversed linkage, will result in a nucleic acid having an overall 5'-5' end structure (i.e. the conventional 3' end nucleoside becomes a 5' end nucleoside). Alternatively, it will be appreciated that the presence of a terminal nucleoside having a change of orientation and a proximal 5'-5' reversed linkage will result in a nucleic acid with an overall 3'-3' end structure.

The proximal 3'-3' or 5'-5' reversed linkage as herein described, may comprise the reversed linkage being directly adjacent/attached to a terminal nucleoside having an inverted orientation, such as a single terminal nucleoside having an inverted orientation. Alternatively, the proximal 3'-3' or 5'-5' reversed linkage as herein described, may comprise the reversed linkage being adjacent 2, or more than 2, nucleosides having an inverted orientation, such as 2, or more than 2, terminal region nucleosides having an inverted orientation, such as the terminal and penultimate nucleosides. In this way, the reversed linkage may be attached to a penultimate nucleoside having an inverted orientation. While a skilled addressee will appreciate that inverted orientations as described above can result in nucleic acid molecules having overall 3'-3' or 5'-5' end structures as described herein, it will also be appreciated that with the presence of one or more additional reversed linkages and/or nucleosides having an inverted orientation, then the overall nucleic acid may have 3'-5' end structures corresponding to the conventionally positioned 5'/3' ends.

In one aspect the nucleic acid may have a 3'-3' reversed linkage, and the terminal sugar moiety may comprise a 5' OH rather than a 5' phosphate group at the 5' position of that terminal sugar.

A skilled person would therefore clearly understand that 5'-5', 3'-3' and 3'-5' (reading in the direction of that terminus) end variants of the more conventional 5'-3' structures (with reference to the numbering of ring atoms on the end nucleoside sugars) drawn herein are included in the scope of the disclosure, where a reversed linkage or linkages is/are present.

In the situation of e.g. a reversed internucleoside linkage and/or one or more nucleosides having an inverted orientation creating an inverted end, and where the relative position of a linkage (e.g. to a linker) or the location of an internal feature (such as a modified nucleoside) is defined relative to the 5' or 3' end of the nucleic acid, then the 5' or 3' end is the conventional 5' or 3' end which would have existed had a reversed linkage not been in place, and wherein the conventional 5' or 3' end is determined by consideration of the directionality of the majority of the internal nucleoside linkages and/or nucleoside orientation within the nucleic acid. It is possible to tell from these internal bonds and/or nucleoside orientation which ends of the nucleic acid would constitute the conventional 5' and 3' ends (with reference to the numbering of ring atoms on the end nucleoside sugars) of the molecule absent the reversed linkage.

For example, in the structure shown below there are abasic residues in the first 2 positions located at the "5'" end. Where the terminal nucleoside has an inverted orientation then the "5'" end indicated in the diagram below, which is the conventional 5' end, can in fact comprise a 3' OH in view of the inverted nucleoside at the terminal position. Nevertheless the majority of the molecule will comprise conventional internucleoside linkages that run from the 3' OH of the sugar to the 5' phosphate of the next sugar, when reading in the standard 5' [P04] to 3' [OH] direction of a nucleic acid molecule (with reference to the numbering of ring atoms on the nucleoside sugars), which can be used to determine the conventional 5' and 3' ends that would be found absent the inverted end configuration.

```
A   5' A-A-Me-Me-Me-Me-Me-Me-F-Me-F-F-F-Me-Me-Me-Me-
    Me-Me-Me-Me-Me-Me 3'
```

The reversed bond is preferably located at the end of the nucleic acid e.g. RNA which is distal to a ligand moiety, such as a GalNAc containing portion, of the molecule. GalNAc-siRNA constructs with a 5'-GalNAc on the sense strand can have a reversed linkage on the opposite end of the sense strand.

GalNAc-siRNA constructs with a 3'-GalNAc on the sense strand can have a reversed linkage on the opposite end of the sense strand.

Nucleic Acid Lengths

In one aspect the i) the first strand of the nucleic acid has a length in the range of 17 to 30 nucleosides, preferably 19 to 25 nucleosides, more preferably 19 or 23 nucleosides; and/or ii) the second strand of the nucleic acid has a length in the range of 17 to 30 nucleosides, preferably 19 to 25 nucleosides, more preferably 19 or 21 nucleosides.

Typically, the duplex region of the nucleic acid is between 17 and 30 nucleosides in length, more preferably is 19 or 21 nucleosides in length. Similarly, the region of complementarity between the first strand and the portion of RNA transcribed from the B4GALT1 gene is between 17 and 30 nucleosides in length.

In one aspect the i) the first strand of the nucleic acid has a length in the range of 15 to 30 nucleosides, preferably 19 to 25 nucleosides, more preferably 23 or 25; and/or ii) the second strand of the nucleic acid has a length in the range of 15 to 30 nucleosides, preferably 19 to 25 nucleosides, more preferably 23.

Generally, the duplex structure of the nucleic acid e.g. an iRNA is about 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

Similarly, the region of complementarity of an antisense sequence to a target sequence and/or the region of complementarity of an antisense sequence to a sense sequence is about 15 to 30 nucleosides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleosides in length. Ranges and lengths intermediate to the above recited ranges and lengths are also contemplated to be part of the invention.

In certain preferred embodiments, the region of complementarity of an antisense sequence to a target sequence and/or the region of complementarity of an antisense sequence to a sense sequence is at least 17 nucleosides in length. For example, the region of complementarity between the antisense strand and the target is 19 to 21 nucleosides in length, for example, the region of complementarity is 21 nucleosides in length.

In preferred embodiments, each strand is no more than 30 nucleosides in length. In certain embodiments, the duplex structure of the nucleic acid e.g. an siRNA is 19 base pairs in length. In particularly preferred embodiment, the duplex may have the structure of FIG. 15A or FIG. 15B.

A nucleic acid e.g. a dsRNA as described herein can further include one or more single-stranded nucleoside overhangs e.g., 1-4, 2-4, 1-3, 2-3, 1, 2, 3, or 4 nucleosides. A nucleoside overhang can comprise or consist of a nucleoside/nucleoside analog, including a deoxynucleoside/nucleoside. The overhang(s) can be on the sense strand, the antisense strand, or any combination thereof. Furthermore, the nucleoside(s) of an overhang can be present on the 5'-end, 3'-end, or both ends of an antisense or sense strand of a nucleic acid e.g. a dsRNA.

In certain preferred embodiments, at least one strand comprises a 3' overhang of at least 1 nucleoside, e.g., at least one strand comprises a 3' overhang of at least 2 nucleosides. The overhang is suitably on the antisense/guide strand and/or the sense/passenger strand.

Nucleic Acid Modifications

In certain embodiments, the nucleic acid, e.g. an RNA of the invention e.g., a dsiRNA, does not comprise further modifications, e.g., chemical modifications or conjugations known in the art and described herein.

In other preferred embodiments, the nucleic acid e.g. RNA of the invention, e.g., a dsiRNA, is further chemically modified to enhance stability or other beneficial characteristics.

In certain embodiments of the invention, substantially all of the nucleosides are modified.

The nucleic acids featured in the invention can be synthesized or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference.

Modifications include, for example, end modifications, e.g., 5-end modifications (phosphorylation, conjugation, inverted linkages) or 3'-end modifications (conjugation, DNA nucleosides within an RNA, or RNA nucleosides within a DNA, inverted linkages, etc.); base modifications, e.g., replacement with stabilizing bases, destabilizing bases, or bases that base pair with an expanded repertoire of partners, conjugated bases; sugar modifications (e.g., at the 2'-position or 4'-position) or replacement of the sugar; or backbone modifications, including modification or replacement of the phosphodiester linkages.

Specific examples of nucleic acids such as siRNA compounds useful in the embodiments described herein include, but are not limited to RNAs containing modified backbones or no natural internucleoside linkages. Nucleic acids such as RNAs having modified backbones include, among others, those that do not have a phosphorus atom in the backbone. For the purposes of this specification, and as sometimes referenced in the art, modified nucleic acids e.g. RNAs that do not have a phosphorus atom in their internucleoside backbone can also be considered to be oligonucleosides. In some embodiments, a modified nucleic acid e.g. an siRNA will have a phosphorus atom in its internucleoside backbone.

Modified nucleic acid e.g. RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 5'-3' or 5'-2'. Various salts, mixed salts and free acid forms are also included.

Modified nucleic acids e.g. RNAs can also contain one or more substituted sugar moieties. The nucleic acids e.g. siRNAs, e.g., dsiRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted. 2' O-methyl and 2'-F are preferred modifications.

In certain preferred embodiments, the nucleic acid comprises at least one modified nucleoside.

The nucleic acid of the invention may comprise one or more modified nucleosides on the first strand and/or the second strand.

In some embodiments, substantially all of the nucleosides of the sense strand and all of the nucleosides of the antisense strand comprise a modification.

In some embodiments, all of the nucleosides of the sense strand and substantially all of the nucleosides of the antisense strand comprise a modification.

In some embodiments, all of the nucleosides of the sense strand and all of the nucleosides of the antisense strand comprise a modification.

In one embodiment, at least one of the modified nucleosides is selected from the group consisting of a deoxynucleoside, a 3'-terminal deoxy-thymine (dT) nucleoside, a 2-O-methyl modified nucleoside (also called herein 2'-Me, where Me is a methoxy), a 2'-fluoro modified nucleoside, a 2'-deoxy-modified nucleoside, a locked nucleoside, an unlocked nucleoside, a conformationally restricted nucleoside, a constrained ethyl nucleoside, an abasic nucleoside, a 2'-amino-modified nucleoside, a 2'-O-allyl-modified nucleoside, 2'-C-alkyl-modified nucleoside, 2'-hydroxly-modified nucleoside, a 2'-methoxyethyl modified nucleoside, a 2'-O-alkyl-modified nucleoside, a morpholino nucleoside, a phosphoramidate, a non-natural base comprising nucleoside, a tetrahydropyran modified nucleoside, a 1,5-anhydrohexitol modified nucleoside, a cyclohexenyl modified nucleoside, a nucleoside comprising a phosphorothioate group, a nucleoside comprising a methylphosphonate group, a nucleoside comprising a 5'-phosphate, and a nucleoside comprising a 5'-phosphate mimic. In another embodiment, the modified nucleosides comprise a short sequence of 3'-terminal deoxy-thymine nucleosides (dT).

Modifications on the nucleosides may preferably be selected from the group including, but not limited to, LNA, HNA, CeNA, 2-methoxyethyl, 2'-O-alkyl, 2-O-allyl, 2'-C—allyl, 2'-fluoro, 2'-deoxy, 2'-hydroxyl, and combinations thereof. In another embodiment, the modifications on the nucleosides are 2'O-methyl ("2-Me") or 2'-fluoro modifications.

One preferred modification is a modification at the 2'-OH group of the ribose sugar, optionally selected from 2'-Me or 2'-F modifications.

Preferred nucleic acid comprise one or more nucleosides on the first strand and/or the second strand which are modified, to form modified nucleosides, as follows:

A nucleic acid wherein the modification is a modification at the 2'-OH group of the ribose sugar, optionally selected from 2'-Me or 2'-F modifications.

A nucleic acid wherein the first strand comprises a 2'-F modification at any of position 2, position 6, position 14, or any combination thereof, counting from position 1 of said first strand.

A nucleic acid wherein the second strand comprises a 2'-F modification at any of position 7, position 9, position 11, or any combination thereof, counting from position 1 of said second strand.

A nucleic acid wherein the second strand comprises a 2'-F modification at position 7 and/or 9, and/or 11, and/or 13, counting from position 1 of said second strand.

A nucleic acid wherein the second strand comprises a 2'-F modification at position 7 and 9 and 11 counting from position 1 of said second strand.

A nucleic acid wherein the first and second strand each comprise 2-Me and 2'-F modifications.

A nucleic which comprises at least one thermally destabilizing modification, suitably at one or more of positions 1 to 9 of the first strand counting from position 1 of the first strand, and/or at one or more of positions on the second strand aligned with positions 1 to 9 of the first strand, wherein the destabilizing modification is selected from a modified unlocked nucleic acid (UNA) and a glycol nucleic acid (GNA), preferably a glycol nucleic acid.

A nucleic acid wherein the nucleic acid comprises 3 or more 2'-F modifications at positions 7 to 13 of the second strand, such as 4, 5, 6 or 7 2'-F modifications at positions 7 to 13 of the second strand, counting from position 1 of said second strand.

A nucleic acid wherein said second strand comprises at least 3, such as 4, 5 or 6, 2'-Me modifications at positions 1 to 6 of the second strand, counting from position 1 of said second strand.

A nucleic acid wherein said first strand comprises at least 5 2'-Me consecutive modifications at the 3' terminal region, preferably including the terminal nucleoside at the 3' terminal region, or at least within 1 or 2 nucleosides from the terminal nucleoside at the 3' terminal region.

A nucleic acid wherein said first strand comprises 7 2'-Me consecutive modifications at the 3' terminal region, preferably including the terminal nucleoside at the 3' terminal region.

A nucleic acid which comprises at least one thermally destabilizing modification at position 7 of the first strand, counting from position 1 of the first strand.

A nucleic acid which is an siRNA oligonucleoside, wherein the siRNA oligonucleoside comprises at least 3 2'-F modifications at positions 6 to 12 of the second strand, counting from position 1 of said second strand.

A nucleic acid which is an siRNA oligonucleoside, wherein said second strand comprises at least 3 2'-Me modifications at positions 1 to 6 of the second strand, counting from position 1 of said second strand.

A nucleic acid which is an siRNA oligonucleoside, wherein each of the first and second strands comprises an alternating modification pattern, preferably a fully alternating modification pattern along the entire length of each of the first and second strands, wherein the nucleosides of the first strand are modified by (i) 2'Me modifications on the odd numbered nucleosides counting from position 1 of the first strand, and (ii) 2'F modifications on the even numbered nucleosides counting from position 1 of the first strand, and nucleosides of the second strand are modified by (i) 2'F modifications on the odd numbered nucleosides counting from position 1 of the second strand, and (ii) 2'Me modifications on the even numbered nucleosides counting from position 1 of the second strand. Typically, such fully alternating modification patterns are present in a blunt ended oligonucleoside, wherein each of the first and second strands are 19 or 23 nucleosides in length.

Position 1 of the first or the second strand is the nucleoside which is the closest to the end of the nucleic acid (ignoring any abasic nucleosides) and that is joined to an adjacent nucleoside (at Position 2) via a 3' to 5' internal bond, with reference to the bonds between the sugar moieties of the backbone, and reading in a direction away from that end of the molecule.

It can therefore be seen that "position 1 of the sense strand" is the 5' most nucleoside (not including abasic nucleosides) at the conventional 5' end of the sense strand. Typically, the nucleoside at this position 1 of the sense strand will be equivalent to the 5' nucleoside of the selected target nucleic acid sequence, and more generally the sense strand will have equivalent nucleosides to those of the target nucleic acid sequence starting from this position 1 of the sense strand, whilst also allowing for acceptable mismatches between the sequences.

As used herein, "position 1 of the antisense strand" is the 5' most nucleoside (not including abasic nucleosides) at the conventional 5' end of the antisense strand. As hereinbefore described, there will be a region of complementarity between the sense and antisense strands, and in this way the antisense strand will also have a region of complementarity to the target nucleic acid sequence as referred to above.

In certain embodiments, the nucleic acid e.g. RNAi agent further comprises at least one phosphorothioate or methylphosphonate internucleoside linkage. For example the phosphorothioate or methylphosphonate internucleoside linkage can be at the 3'-terminus or in the terminal region of one strand, i.e., the sense strand or the antisense strand; or at the ends of both strands, the sense strand and the antisense strand.

In certain embodiments, the phosphorothioate or methylphosphonate internucleoside linkage is at the 5'terminus or in the terminal region of one strand, i.e., the sense strand or the antisense strand; or at the ends of both strands, the sense strand and the antisense strand.

In certain embodiments, a phosphorothioate or a methylphosphonate internucleoside linkage is at both the 5'- and 3'-terminus or in the terminal region of one strand, i.e., the sense strand or the antisense strand; or at the ends of both strands, the sense strand and the antisense strand.

Any nucleic acid may comprise one or more phosphorothioate (PS) modifications within the nucleic acid, such as at least two PS internucleoside bonds at the ends of a strand.

At least one of the oligoribonucleoside strands preferably comprises at least two consecutive phosphorothioate modifications in the last 3 nucleosides of the oligonucleoside.

The invention therefore also relates to: A nucleic acid disclosed herein which comprises phosphorothioate internucleoside linkages respectively between at least two or three consecutive positions, such as in a 5' and/or 3' terminal region and/or near terminal region of the second strand, whereby said near terminal region is preferably adjacent said terminal region wherein said one or more abasic nucleosides of said second strand is/are located.

A nucleic acid disclosed herein which comprises phosphorothioate internucleoside linkages respectively between at least two or three consecutive positions in a 5' and/or 3' terminal region of the first strand, whereby preferably the terminal position at the 5' and/or 3' terminal region of said first strand is attached to its adjacent position by a phosphorothioate internucleoside linkage.

The nucleic acid strand may be an RNA comprising a phosphorothioate internucleoside linkage between the three nucleosides contiguous with 2 terminally located abasic nucleosides.

A preferred nucleic acid is a double stranded RNA comprising 2 adjacent abasic nucleosides at the 5' terminus of the second strand and a ligand moiety comprising one or more GalNAc ligand moieties at the opposite 3' end of the second strand. Further preferred, the same nucleic acid may also comprise a phosphorothioate bond between nucleotides at positions 3-4 and 4-5 of the second strand, reading from the position 1 of the second strand. Further preferred, the same nucleic acid may also comprise a 2' F modification at positions 7, 9 and 11 of the second strand.

Preferred modifications of nucleic acids having the structure of FIG. 15A are as follows:

A nucleic acid wherein modified nucleosides of the first strand have a modification pattern according to (5'-3'):

```
Me - F - Me - F - Me - F - Me - F - Me - F - Me -
F - Me - F - Me - F - Me - F - Me.
```

A nucleic acid wherein modified nucleosides of said second strand have a modification pattern according to (5'-3'):

```
F(s)Me(s)F - Me - F - Me - F - Me - F - Me - F -
Me - F - Me - F - Me - F - Me - F,
or
F - Me - F - Me - F - Me - F - Me - F - Me - F -
Me - F - Me - F - Me - F(s)Me(s)F;
```

wherein (s) is a phosphorothioate internucleoside linkage.

A nucleic acid wherein modified nucleosides of the second strand have a modification pattern according to (5'-3'):

```
F - Me - F - Me - F - Me - F - Me - F - Me - F -
Me - F - Me - F - Me - F - Me - F.
```

A nucleic acid wherein modified nucleosides of said second strand have a modification pattern according to (5'-3'):

```
F(s)Me(s)F - Me - F - Me - F - Me - F - Me - F -
Me - F - Me - F - Me - F - Me - F,
or
F - Me - F - Me - F - Me - F - Me - F - Me - F -
Me - F - Me - F - Me - F(s)Me(s)F;
```

wherein (s) is a phosphorothioate internucleoside linkage.

A nucleic acid wherein modified nucleosides of said second strand have a modification pattern according to (5'-3'):

```
ia - ia - F - Me - F - Me - F - Me - F - Me - F -
Me - F - Me - F - Me - F - Me - F - Me - F,
or
F - Me - F - Me - F - Me - F - Me - F - Me - F -
Me - F - Me - F - Me - F - Me - F - ia - ia;
```

wherein ia represents an inverted abasic nucleoside. In certain embodiments, the inverted abasic nucleosides as represented by ia-ia are present in a 2 nucleoside overhang.

A nucleic acid wherein modified nucleosides of said second strand have a modification pattern according to any one of the following (5'-3'):

```
ia - ia - F(s)Me(s)F - Me - F - Me - F - Me - F -
Me - F - Me - F - Me - F - Me - F - Me - F,
or
F - Me - F - Me - F - Me - F - Me - F - Me - F -
Me - F - Me - F - Me - F - Me(s)F(s)ia - ia;
```

wherein (s) is a phosphorothioate internucleoside linkage and ia represents an inverted abasic nucleoside. In certain embodiments, the inverted abasic nucleosides as represented by ia-ia are present in a 2 nucleoside overhang.

Preferred modifications of nucleic acids having the structure of FIG. 15B are as follows:

A nucleic acid wherein modified nucleosides of said second strand comprise a modification pattern according to any one of the following (5'-3'):

```
Me - Me - Me - Me - Me - Me - F - F - F - F - F -
Me - Me - Me - Me - Me - Me - Me - F - Me - Me,
or
Me - Me - Me - Me - Me - F - F - Me - F - F - F -
F - Me - Me - Me - Me - Me - Me - Me - Me - Me,
or
Me - Me - Me - Me - Me - Me -F- Me - F - F - F -
F - Me - Me - Me - Me - Me - Me - Me - Me - Me,
or
Me - Me - Me - Me - Me - Me - Me - Me - F - F -
F - Me - Me - Me - Me - Me - Me - Me - Me - Me -
Me,
or
Me - Me - Me - Me - Me - Me - F - Me - F - F - F -
Me - Me - Me - Me - Me - Me - Me - Me - Me - Me.
```

A nucleic acid wherein modified nucleosides of said second strand comprise a modification pattern according to any one of the following (5'-3'):

```
Me(s)Me(s)Me - Me - Me - Me - F - F - F - F - F -
Me - Me - Me - Me - Me - Me - Me - F - Me - Me,
or
Me(s)Me(s)Me - Me - Me - F - F - Me - F - F - F -
F - Me - Me - Me - Me - Me - Me - Me - Me - Me,
or
Me(s)Me(s)Me - Me - Me - Me -F- Me - F - F - F -
F - Me - Me - Me - Me - Me - Me - Me - Me - Me,
or
Me(s)Me(s)Me - Me - Me - Me - Me - Me - F - F -
F - Me - Me - Me - Me - Me - Me - Me - Me - Me -
Me,
or
Me(s)Me(s)Me - Me - Me - Me - F - Me - F - F - F -
Me - Me - Me - Me - Me - Me - Me - Me - Me - Me,
or
Me - Me - Me - Me - Me - Me - F - F - F - F - F -
Me - Me - Me - Me - Me - Me - Me - F(s)Me(s)Me,
or
Me - Me - Me - Me - Me - F - F - Me - F - F - F -
F - Me - Me - Me - Me - Me - Me - Me(s)Me(s)Me,
or
Me - Me - Me - Me - Me - Me -F- Me - F - F - F -
F - Me - Me - Me - Me - Me - Me - Me(s)Me(s)Me,
or
Me - Me - Me - Me - Me - Me - Me - Me - F - F -
F - Me - Me - Me - Me - Me - Me - Me -
Me(s)Me(s)Me,
or
Me - Me - Me - Me - Me - Me - F - Me - F - F - F -
Me - Me - Me - Me - Me - Me - Me - Me(s)Me(s)Me,
```

wherein (s) is a phosphorothioate internucleoside linkage.

A nucleic acid wherein modified nucleosides of said second strand comprise a modification pattern according to any one of the following (5'-3'):

```
ia - ia - Me - Me - Me - Me - Me - Me - F - F -
F - F - F - Me - Me - Me - Me - Me - Me - Me - F -
Me - Me,
or

ia - ia - Me - Me - Me - Me - Me - F - F - Me -
F - F - F - F - Me - Me - Me - Me - Me - Me - Me -
Me - Me,
or

ia - ia - Me - Me - Me - Me - Me - Me -F- Me - F -
F - F - F - Me - Me - Me - Me - Me - Me - Me -
Me - Me,
or

ia - ia - Me - Me - Me - Me - Me - Me - Me - Me -
F - F - F - Me - Me - Me - Me - Me - Me - Me -
Me - Me - Me,
or

ia - ia - Me - Me - Me - Me - Me - Me - F - Me -
F - F - F - Me - Me - Me - Me - Me - Me - Me -
Me - Me - Me,
or

Me - Me - Me - Me - Me - Me - F - F - F - F - F -
Me - Me - Me - Me - Me - Me - Me - F - Me - Me -
ia - ia,
or

Me - Me - Me - Me - Me - F - F - Me - F - F - F -
F - Me - Me - Me - Me - Me - Me - Me - Me - Me -
ia - ia,
or

Me - Me - Me - Me - Me - Me -F- Me - F - F - F -
F - Me - Me - Me - Me - Me - Me - Me - Me - Me -
ia - ia,
or

Me - Me - Me - Me - Me - Me - Me - Me - F - F -
F - Me - Me - Me - Me - Me - Me - Me - Me - Me -
Me - ia - ia,
or

Me - Me - Me - Me - Me - Me - F - Me - F - F - F -
Me - Me - Me - Me - Me - Me - Me - Me - Me - Me-
ia - ia,
```

wherein ia represents an inverted abasic nucleoside, and when the inverted abasic nucleosides as represented by ia-ia are present at the 3' terminus of the second strand, said inverted abasic nucleosides are present in a 2 nucleoside overhang.

A nucleic acid wherein modified nucleosides of said second strand comprise a modification pattern according to any one of the following (5'-3'):

```
ia - ia - Me(s)Me(s)Me - Me - Me - Me - F - F -
F - F - F - Me - Me - Me - Me - Me - Me - Me - F -
Me - Me,
or

ia - ia - Me(s)Me(s)Me - Me - Me - F - F - Me -
F - F - F - F - Me - Me - Me - Me - Me - Me - Me -
Me - Me,
or

ia - ia - Me(s)Me(s)Me - Me - Me - Me -F- Me - F -
F - F - F - Me - Me - Me - Me - Me - Me - Me -
Me - Me,
```

-continued

```
or

ia - ia - Me(s)Me(s)Me - Me - Me - Me - Me - Me -
F - F - F - Me - Me - Me - Me - Me - Me - Me -
Me - Me - Me,
or

ia - ia - Me(s)Me(s)Me - Me - Me - Me - F - Me -
F - F - F - Me - Me - Me - Me - Me - Me - Me -
Me - Me - Me,
or

Me - Me - Me - Me - Me - Me - F - F - F - F - F -
Me - Me - Me - Me - Me - Me - Me - F(s)Me(s)Me -
ia - ia,
or

Me - Me - Me - Me - Me - F - F - Me - F - F - F -
F - Me - Me - Me - Me - Me - Me - Me(s)Me(s)Me -
ia - ia,
or

Me - Me - Me - Me - Me - Me -F- Me - F - F - F -
F - Me - Me - Me - Me - Me - Me - Me(s)Me(s)Me -
ia - ia,
or

Me - Me - Me - Me - Me - Me - Me - Me - F - F -
F - Me - Me - Me - Me - Me - Me - Me -
Me(s)Me(s)Me - ia - ia,
or

Me - Me - Me - Me - Me - Me - F - Me - F - F -
F - Me - Me - Me - Me - Me - Me - Me -
Me(s)Me(s)Me - ia - ia,
```

wherein:

(s) is a phosphorothioate internucleoside linkage, ia represents an inverted abasic nucleoside, and when the inverted abasic nucleosides as represented by ia-ia are present at the 3' terminus of the second strand, said inverted abasic nucleosides are present in a 2 nucleoside overhang.

A nucleic acid wherein modified nucleosides comprise any one of the following modification patterns:

```
Modification pattern 1:
Second strand (5'-3'):
Me - Me - Me - Me - Me - Me - F - F - F - F - F -
Me - Me - Me - Me - Me - Me - Me - F - Me - Me,

First strand (5'-3'):
Me - F - Me - F - Me - F - Me - F - F - Me - Me -
Me - Me - F - Me - F - Me - Me - Me - Me - Me -
Me - Me
Or

Modification pattern 2:
Second strand (5'-3'):
Me - Me - Me - Me - Me - F - F - Me - F - F - F -
F - Me - Me - Me - Me - Me - Me - Me - Me - Me,

First strand (5'-3'):
Me - F - Me - F - Me - F - Me - F - F - Me - Me -
Me - Me - F - Me - F - Me - Me - Me - Me - Me -
Me - Me
Or

Modification pattern 3:
Second strand (5'-3'):
Me - Me - Me - Me - Me - Me -F- Me - F - F - F -
F - Me - Me - Me - Me - Me - Me - Me - Me - Me,

First strand (5'-3'):
Me - F - Me - F - Me - F - Me - F - F - Me - Me -
Me - Me - F - Me - F - Me - Me - Me - Me - Me -
Me - Me
```

-continued

```
Or

Modification pattern 4:
Second strand (5'-3'):
Me - Me - Me - Me - Me - Me - F - Me - F - F - F -
F - Me - Me - Me - Me - Me - Me - Me - Me - Me,

First strand (5'-3'):
Me - F - Me - F - Me - F - Me - Me - Me - Me -
Me - Me - Me - F - Me - F - Me - Me - Me - Me -
Me - Me - Me
Or

Modification pattern 5:
Second strand (5'-3'):
Me - Me - Me - Me - Me - Me - Me - Me - F - F -
F - Me - Me - Me - Me - Me - Me - Me - Me - Me -
Me,

First strand (5'-3'):
Me - F - Me - Me - Me - F - Me - Me - F - Me -
Me - Me - Me - F - Me - F - Me - Me - Me - Me -
Me - Me - Me
Or

Modification pattern 6:
Second strand (5'-3'):
Me - Me - Me - Me - Me - Me - F - Me - F - F - F -
Me - Me - Me - Me - Me - Me - Me - Me - Me - Me,

First strand (5'-3'):
Me - F - Me - Me - Me - F - Me - Me - F - Me -
Me - Me - Me - F - Me - F - Me - Me - Me - Me -
Me - Me - Me.
```

A nucleic acid wherein modified nucleosides comprise any one of the following modification patterns:

```
Modification pattern 1:
Second strand (5'-3'):
Me(s)Me(s)Me - Me - Me - Me - F - F - F - F - F -
Me - Me - Me - Me - Me - Me - Me - F - Me - Me,

First strand (5'-3'):
Me(s)F(s)Me - F - Me - F - Me - F - F - Me - Me -
Me - Me - F - Me - F - Me - Me - Me - Me -
Me(s)Me(s)Me
Or

Modification pattern 2:
Second strand (5'-3'):
Me(s)Me(s)Me - Me - Me - F - F - Me - F - F - F -
F - Me - Me - Me - Me - Me - Me - Me - Me - Me,

First strand (5'-3'):
Me(s)F(s)Me - F - Me - F - Me - F - F - Me - Me -
Me - Me - F - Me - F - Me - Me - Me - Me -
Me(s)Me(s)Me
Or

Modification pattern 3:
Second strand (5'-3'):
Me(s)Me(s)Me - Me - Me - Me -F- Me - F - F - F -
F - Me - Me - Me - Me - Me - Me - Me - Me - Me,

First strand (5'-3'):
Me(s)F(s)Me - F - Me - F - Me - F - F - Me - Me -
Me - Me - F - Me - F - Me - Me - Me - Me -
Me(s)Me(s)Me
Or

Modification pattern 4:
Second strand (5'-3'):
Me(s)Me(s)Me - Me - Me - Me - F - Me - F - F - F -
F - Me - Me - Me - Me - Me - Me - Me - Me - Me,
```

-continued

```
First strand (5'-3'):
Me(s)F(s)Me - F - Me - F - Me - Me - Me - Me -
Me - Me - Me - F - Me - F - Me - Me - Me - Me -
Me(s)Me(s)Me
Or

Modification pattern 5:
Second strand (5'-3'):
Me(s)Me(s)Me - Me - Me - Me - Me - Me - F - F -
F - Me - Me - Me - Me - Me - Me - Me - Me - Me -
Me,

First strand (5'-3'):
Me(s)F(s)Me - Me - Me - F - Me - Me - F - Me -
Me - Me - Me - F - Me - F - Me - Me - Me - Me -
Me(s)Me(s)Me
Or

Modification pattern 6:
Second strand (5'-3'):
Me(s)Me(s)Me - Me - Me - Me - F - Me - F - F - F -
Me - Me - Me - Me - Me - Me - Me - Me - Me - Me,

First strand (5'-3'):
Me(s)F(s)Me - Me - Me - F - Me - Me - F - Me -
Me - Me - Me - F - Me - F - Me - Me - Me - Me -
Me(s)Me(s)Me
```

wherein (s) is a phosphorothioate internucleoside linkage.

A nucleic acid wherein modified nucleosides comprise any one of the following modification patterns:

```
Modification pattern 1:
Second strand (5'-3'):
Me - Me - Me - Me - Me - Me - F - F - F - F - F -
Me - Me - Me - Me - Me - Me - Me - F(s)Me(s)Me,

First strand (5'-3'):
Me(s)F(s)Me - F - Me - F - Me - F - F - Me - Me -
Me - Me - F - Me - F - Me - Me - Me - Me -
Me(s)Me(s)Me
Or

Modification pattern 2:
Second strand (5'-3'):
Me - Me - Me - Me - Me - F - F - Me - F - F - F -
F - Me - Me - Me - Me - Me - Me - Me(s)Me(s)Me,

First strand (5'-3'):
Me(s)F(s)Me - F - Me - F - Me - F - F - Me - Me -
Me - Me - F - Me - F - Me - Me - Me - Me -
Me(s)Me(s)Me
Or

Modification pattern 3:
Second strand (5'-3'):
Me - Me - Me - Me - Me - Me -F- Me - F - F - F -
F - Me - Me - Me - Me - Me - Me - Me(s)Me(s)Me,

First strand (5'-3'):
Me(s)F(s)Me - F - Me - F - Me - F - F - Me - Me -
Me - Me - F - Me - F - Me - Me - Me - Me -
Me(s)Me(s)Me
Or

Modification pattern 4:
Second strand (5'-3'):
Me - Me - Me - Me - Me - Me - F - Me - F - F - F -
F - Me - Me - Me - Me - Me - Me - Me(s)Me(s)Me,

First strand (5'-3'):
Me(s)F(s)Me - F - Me - F - Me - Me - Me - Me -
Me - Me - Me - F - Me - F - Me - Me - Me - Me -
Me(s)Me(s)Me
```

-continued

Or

Modification pattern 5:
Second strand (5'-3'):
Me - Me - Me - Me - Me - Me - Me - Me - F - F -
F - Me - Me - Me - Me - Me - Me - Me -
Me(s)Me(s)Me, First strand (5'-3'):
Me(s)F(s)Me - Me - Me - F - Me - Me - F - Me -
Me - Me - Me - F - Me - F - Me - Me - Me - Me -
Me(s)Me(s)Me
Or Modification pattern 6:
Second strand (5'-3'):
Me - Me - Me - Me - Me - Me - F - Me - F - F - F -
Me - Me - Me - Me - Me - Me - Me - Me(s)Me(s)Me, First strand (5'-3'):
Me(s)F(s)Me - Me - Me - F - Me - Me - F - Me -
Me - Me - Me - F - Me - F - Me - Me - Me - Me -
Me(s)Me(s)Me wherein (s) is a phosphorothioate internucleoside linkage.

A nucleic acid wherein modified nucleosides comprise any one of the following modification patterns:

Modification pattern 1:
Second strand (5'-3'):
ia - ia - Me - Me - Me - Me - Me - Me - F - F -
F - F - F - Me - Me - Me - Me - Me - Me - Me - F -
Me - Me, First strand (5'-3'):
Me - F - Me - F - Me - F - Me - F - F - Me - Me -
Me - Me - F - Me - F - Me - Me - Me - Me - Me -
Me - Me
Or Modification pattern 2:
Second strand (5'-3'):
ia - ia - Me - Me - Me - Me - Me - F - F - Me -
F - F - F - F - Me - Me - Me - Me - Me - Me - Me -
Me - Me, First strand (5'-3'):
Me - F - Me - F - Me - F - Me - F - F - Me - Me -
Me - Me - F - Me - F - Me - Me - Me - Me - Me -
Me - Me
Or Modification pattern 3:
Second strand (5'-3'):
ia - ia - Me - Me - Me - Me - Me - Me - F - Me -
F - F - F - F - Me - Me - Me - Me - Me - Me - Me -
Me - Me, First strand (5'-3'):
Me - F - Me - F - Me - F - Me - F - F - Me - Me -
Me - Me - F - Me - F - Me - Me - Me - Me - Me -
Me - Me
Or Modification pattern 4:
Second strand (5'-3'):
ia - ia - Me - Me - Me - Me - Me - Me - F - Me -
F - F - F - F - Me - Me - Me - Me - Me - Me - Me -
Me - Me, First strand (5'-3'):
Me - F - Me - F - Me - F - Me - Me - Me - Me -
Me - Me - Me - F - Me - F - Me - Me - Me - Me -
Me - Me - Me -continued Or Modification pattern 5:
Second strand (5'-3'):
ia - ia - Me - Me - Me - Me - Me - Me - Me - Me -
F - F - F - Me - Me - Me - Me - Me - Me - Me -
Me - Me - Me, First strand (5'-3'):
Me - F - Me - Me - Me - F - Me - Me - F - Me -
Me - Me - Me - F - Me - F - Me - Me - Me - Me -
Me - Me - Me
Or Modification pattern 6:
Second strand (5'-3'):
ia - ia - Me - Me - Me - Me - Me - Me - F - Me -
F - F - F - Me - Me - Me - Me - Me - Me - Me -
Me - Me - Me, First strand (5'-3'):
Me - F - Me - Me - Me - F - Me - Me - F - Me -
Me - Me - Me - F - Me - F - Me - Me - Me - Me -
Me - Me - Me, wherein ia represents an inverted abasic nucleoside.

A nucleic acid wherein modified nucleosides comprise any one of the following modification patterns:

Modification pattern 1:
Second strand (5'-3'):
Me - Me - Me - Me - Me - Me - F - F - F - F - F -
Me - Me - Me - Me - Me - Me - Me - F - Me - Me -
ia - ia, First strand (5'-3'):
Me - F - Me - F - Me - F - Me - F - F - Me - Me -
Me - Me - F - Me - F - Me - Me - Me - Me - Me -
Me - Me
Or Modification pattern 2:
Second strand (5'-3'):
Me - Me - Me - Me - Me - F - F - Me - F - F - F -
F - Me - Me - Me - Me - Me - Me - Me - Me - Me -
ia - ia, First strand (5'-3'):
Me - F - Me - F - Me - F - Me - F - F - Me - Me -
Me - Me - F - Me - F - Me - Me - Me - Me - Me -
Me - Me
Or Modification pattern 3:
Second strand (5'-3'):
Me - Me - Me - Me - Me - Me -F- Me - F - F - F -
F - Me - Me - Me - Me - Me - Me - Me - Me - Me -
ia - ia, First strand (5'-3'):
Me - F - Me - F - Me - F - Me - F - F - Me - Me -
Me - Me - F - Me - F - Me - Me - Me - Me - Me -
Me - Me
Or Modification pattern 4:
Second strand (5'-3'):
Me - Me - Me - Me - Me - Me - F - Me - F - F - F -
F - Me - Me - Me - Me - Me - Me - Me - Me - Me -
ia - ia, First strand (5'-3'):
Me - F - Me - F - Me - F - Me - Me - Me - Me -
Me - Me - Me - F - Me - F - Me - Me - Me - Me -
Me - Me - Me -continued Or Modification pattern 5:
Second strand (5'-3'):
Me - Me - Me - Me - Me - Me - Me - Me - F - F -
F - Me - Me - Me - Me - Me - Me - Me - Me - Me -
Me - ia - ia, First strand (5'-3'):
Me - F - Me - Me - Me - F - Me - Me - F - Me -
Me - Me - Me - F - Me - F - Me - Me - Me - Me -
Me - Me - Me
Or Modification pattern 6:
Second strand (5'-3'):
Me - Me - Me - Me - Me - Me - F - Me - F - F - F -
Me - Me - Me - Me - Me - Me - Me - Me - Me - Me -
ia - ia, First strand (5'-3'):
Me - F - Me - Me - Me - F - Me - Me - F - Me -
Me - Me - Me - F - Me - F - Me - Me - Me - Me -
Me - Me - Me, wherein ia represents an inverted abasic nucleoside, and when the inverted abasic nucleosides as represented by ia-ia are present at the 3' terminus of the second strand, said inverted abasic nucleosides are present in a 2 nucleoside overhang.

A nucleic acid wherein modified nucleosides comprise any one of the following modification patterns:

Modification pattern 1:
Second strand (5'-3'):
ia - ia - Me(s)Me(s)Me - Me - Me - Me - F - F -
F - F - F - Me - Me - Me - Me - Me - Me - Me - F -
Me - Me, First strand (5'-3'):
Me(s)F(s)Me - F - Me - F - Me - F - F - Me - Me -
Me - Me - F - Me - F - Me - Me - Me - Me -
Me(s)Me(s)Me
Or Modification pattern 2:
Second strand (5'-3'):
ia - ia - Me(s)Me(s)Me - Me - Me - F - F - Me -
F - F - F - F - Me - Me - Me - Me - Me - Me - Me -
Me - Me, First strand (5'-3'):
Me(s)F(s)Me - F - Me - F - Me - F - F - Me - Me -
Me - Me - F - Me - F - Me - Me - Me - Me -
Me(s)Me(s)Me
Or Modification pattern 3:
Second strand (5'-3'):
ia - ia - Me(s)Me(s)Me - Me - Me - Me - F - Me -
F - F - F - F - Me - Me - Me - Me - Me - Me - Me -
Me - Me, First strand (5'-3'):
Me(s)F(s)Me - F - Me - F - Me - F - F - Me - Me -
Me - Me - F - Me - F - Me - Me - Me - Me -
Me(s)Me(s)Me
Or Modification pattern 4:
Second strand (5'-3'):
ia - ia - Me(s)Me(s)Me - Me - Me - Me - F - Me -
F - F - F - F - Me - Me - Me - Me - Me - Me - Me -
Me - Me, -continued First strand (5'-3'):
Me(s)F(s)Me - F - Me - F - Me - Me - Me - Me -
Me - Me - Me - F - Me - F - Me - Me - Me -
Me - Me(s)Me(s)Me
Or Modification pattern 5:
Second strand (5'-3'):
ia - ia - Me(s)Me(s)Me - Me - Me - Me - Me - Me -
F - F - F - Me - Me - Me - Me - Me - Me - Me -
Me - Me - Me, First strand (5'-3'):
Me(s)F(s)Me - Me - Me - F - Me - Me - F - Me -
Me - Me - Me - F - Me - F - Me - Me - Me -
Me - Me(s)Me(s)Me
Or Modification pattern 6:
Second strand (5'-3'):
ia - ia - Me(s)Me(s)Me - Me - Me - Me - F - Me -
F - F - F - Me - Me - Me - Me - Me - Me - Me -
Me - Me - Me, First strand (5'-3'):
Me(s)F(s)Me - Me - Me - F - Me - Me - F - Me -
Me - Me - Me - F - Me - F - Me - Me - Me - Me -
Me(s)Me(s)Me wherein:

(s) is a phosphorothioate internucleoside linkage, ia represents an inverted abasic nucleoside.

A nucleic acid wherein modified nucleosides comprise any one of the following modification patterns:

Modification pattern 1:
Second strand (5'-3'):
Me - Me - Me - Me - Me - Me - F - F - F - F - F -
Me - Me - Me - Me - Me - Me - Me - F(s)Me(s)Me -
ia - ia, First strand (5'-3'):
Me(s)F(s)Me - F - Me - F - Me - F - F - Me - Me -
Me - Me - F - Me - F - Me - Me - Me - Me -
Me(s)Me(s)Me
Or Modification pattern 2:
Second strand (5'-3'):
Me - Me - Me - Me - Me - F - F - Me - F - F - F -
F - Me - Me - Me - Me - Me - Me - Me(s)Me(s)Me -
ia - ia, First strand (5'-3'):
Me(s)F(s)Me - F - Me - F - Me - F - F - Me - Me -
Me - Me - F - Me - F - Me - Me - Me - Me -
Me(s)Me(s)Me
Or Modification pattern 3:
Second strand (5'-3'):
Me - Me - Me - Me - Me - Me - F - Me - F - F - F -
F - Me - Me - Me - Me - Me - Me - Me(s)Me(s)Me -
a - ia, First strand (5'-3'):
Me(s)F(s)Me - F - Me - F - Me - F - F - Me - Me -
Me - Me - F - Me - F - Me - Me - Me - Me -
Me(s)Me(s)Me
Or Modification pattern 4:
Second strand (5'-3'):
Me - Me - Me - Me - Me - Me - F - Me - F - F - F -
F - Me - Me - Me - Me - Me - Me - Me(s)Me(s)Me -
ia - ia, -continued

```
First strand (5'-3'):
Me(s)F(s)Me - F - Me - F - Me - Me - Me - Me -
Me - Me - Me - F - Me - F - Me - Me - Me - Me -
Me(s)Me(s)Me
Or

Modification pattern 5:
Second strand (5'-3'):
Me - Me - Me - Me - Me - Me - Me - Me - F - F -
F - Me - Me - Me - Me - Me - Me - Me -
Me(s)Me(s)Me - ia - ia,

First strand (5'-3'):
Me(s)F(s)Me - Me - Me - F - Me - Me - F - Me -
Me - Me - Me - F - Me - F - Me - Me - Me - Me -
Me(s)Me(s)Me
Or

Modification pattern 6:
Second strand (5'-3'):
Me - Me - Me - Me - Me - Me - F - Me - F - F - F -
Me - Me - Me - Me - Me - Me - Me - Me(s)Me(s)Me -
ia - ia,

First strand (5'-3'):
Me(s)F(s)Me - Me - Me - F - Me - Me - F - Me -
Me - Me - Me - F - Me - F - Me - Me - Me - Me -
Me(s)Me(s)Me
```

wherein: (s) is a phosphorothioate internucleoside linkage, ia represents an inverted abasic nucleoside, and when the inverted abasic nucleosides as represented by ia-ia are present at the 3' terminus of the second strand, said inverted abasic nucleosides are present in a 2 nucleoside overhang.

A nucleic acid wherein the first strand comprises a 2' sugar modification pattern wherein said modifications are selected at least from 2'Me and 2'F sugar modifications, provided that the overall number of 2'F sugar modifications in the first strand does not consist of four, or six, 2'F modifications.

A nucleic acid wherein the first strand comprises a 2' sugar modification pattern wherein said modifications are selected at least from 2'Me and 2'F sugar modifications, wherein the overall number of 2'F sugar modifications in the first strand consists of three, five or seven 2'F modifications.

A nucleic acid wherein the first strand comprises a 2' sugar modification pattern wherein said modifications are selected at least from 2'Me and 2'F sugar modifications, wherein the overall number of 2'F sugar modifications in the first strand consists of three 2'F modifications.

A nucleic acid wherein the first strand comprises a 2' sugar modification pattern wherein said modifications are selected at least from 2'Me and 2'F sugar modifications, wherein the overall number of 2'F sugar modifications in the first strand consists of five 2'F modifications.

A nucleic acid wherein the first strand comprises a 2' sugar modification pattern as follows (5'-3'):

$$Me - F - Me - X_2 - Me - F - (Me)_7 - (F - Me)_2 - X_3 - Me - X_4 - (Me)_3$$

wherein $X_2$, $X_3$ and $X_4$ are selected from 2'Me and 2'F sugar modifications, provided that for $X_2$, $X_3$ and $X_4$ at least one is a 2'F sugar modification, and the other two sugar modifications are 2'Me sugar modifications.

A nucleic acid wherein the first strand comprises a 2' sugar modification pattern as follows (5'-3'):

$$Me - F - Me - X_2 - Me - F - (Me)_7 - (F - Me)_2 - X_3 - Me - X_4 - (Me)_3$$

wherein $X_2$ is a 2'F sugar modification, and $X_3$ and $X_4$ are 2'Me sugar modifications.

A nucleic acid wherein the first strand comprises a 2' sugar modification pattern as follows (5'-3'):

$$Me\text{-}F\text{-}Me\text{-}X_2\text{-}Me\text{-}F\text{-}(Me)_7\text{-}(F\text{-}Me)_2\text{-}X_3\text{-}Me\text{-}X_4\text{-}(Me)_3$$

wherein $X_3$ is a 2'F sugar modification, and $X_2$ and $X_4$ are 2'Me sugar modifications.

A nucleic acid wherein the first strand comprises a 2' sugar modification pattern as follows (5'-3'):

$$Me\text{-}F\text{-}Me\text{-}X_2\text{-}Me\text{-}F\text{-}(Me)_7\text{-}(F\text{-}Me)_2\text{-}X_3\text{-}Me\text{-}X_4\text{-}(Me)_3$$

wherein $X_4$ is a 2'F sugar modification, and $X_2$ and $X_3$ are 2'Me sugar modifications.

A nucleic acid wherein the first strand comprises a 2' sugar modification pattern wherein said modifications are selected at least from 2'Me and 2'F sugar modifications, wherein the overall number of 2'F sugar modifications in the first strand consists of seven 2'F modifications.

A nucleic acid wherein the first strand comprises a 2' sugar modification pattern as follows (5'-3'):

$$Me\text{-}F\text{-}Me\text{-}X_2\text{-}Me\text{-}F\text{-}Me\text{-}(F)_2\text{-}(Me)_4\text{-}(F\text{-}Me)_2\text{-}X_3\text{-}Me\text{-}X_4\text{-}(Me)3$$

wherein $X_2$, $X_3$ and $X_4$ are selected from 2'Me and 2'F sugar modifications, provided that for $X_2$, $X_3$ and $X_4$ at least one is a 2'F sugar modification, and the other two sugar modifications are 2'Me sugar modifications.

A nucleic acid wherein the first strand comprises a 2' sugar modification pattern as follows (5'-3'):

$$Me\text{-}F\text{-}Me\text{-}X_2\text{-}Me\text{-}F\text{-}Me\text{-}(F)_2\text{-}(Me)_4\text{-}(F\text{-}Me)_2\text{-}X_3\text{-}Me\text{-}X_4\text{-}(Me)_3$$

wherein $X_2$ is a 2'F sugar modification, and $X_3$ and $X_4$ are 2'Me sugar modifications.

A nucleic acid wherein the first strand comprises a 2' sugar modification pattern as follows (5'-3'):

$$Me\text{-}F\text{-}Me\text{-}X_2\text{-}Me\text{-}F\text{-}Me\text{-}(F)_2\text{-}(Me)_4\text{-}(F\text{-}Me)_2\text{-}X_3\text{-}Me\text{-}X_4\text{-}(Me)_3$$

wherein $X_3$ is a 2'F sugar modification, and $X_2$ and $X_4$ are 2'Me sugar modifications.

A nucleic acid wherein the first strand comprises a 2' sugar modification pattern as follows (5'-3'):

$$Me\text{-}F\text{-}Me\text{-}X_2\text{-}Me\text{-}F\text{-}Me\text{-}(F)_2\text{-}(Me)_4\text{-}(F\text{-}Me)_2\text{-}X_3\text{-}Me\text{-}X_4\text{-}(Me)_3$$

wherein $X_4$ is a 2'F sugar modification, and $X_2$ and $X_3$ are 2'Me sugar modifications.

A nucleic acid wherein the first strand comprises a 2' sugar modification pattern as follows (5'-3'):

Me-F-(Me)$_3$-X$_1$-(Me)$_7$-F-Me-F-(Me)$_7$ wherein $X_1$ is a thermally destabilising modification.

A nucleic acid wherein the first strand comprises a 2' sugar modification pattern as follows (5'-3'):

Me-F-(Me)$_3$-X$_1$-Me-(F)$_2$-(Me)$_4$-F-Me-F-(Me)$_7$ wherein $X_1$ is a thermally destabilising modification.

A nucleic acid wherein the second strand comprises a 2' sugar modification pattern as follows (5'-3'):

(Me)$_8$-(F)$_3$-(Me)$_{10}$.

A nucleic acid wherein the second strand comprises a 2' sugar modification pattern as follows (5'-3'):

(Me)$_8$-(F)$_3$-(Me)$_{10}$, and wherein the first strand comprises a 2' sugar modification pattern wherein said modifications are selected at least from 2'Me and 2'F sugar modifications, provided that the overall number of 2'F sugar modifications in the first strand does not consist of four, or six, 2'F modifications.

A nucleic acid wherein the second strand comprises a 2' sugar modification pattern as follows (5'-3'):

(Me)$_8$-(F)$_3$-(Me)$_{10}$, and wherein the first strand comprises a 2' sugar modification pattern wherein said modifications are selected at least from 2'Me and 2'F sugar modifications, wherein the overall number of 2'F sugar modifications in the first strand consists of three, five or seven 2'F modifications.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar modification pattern as follows (5'-3'):

(Me)$_8$-(F)$_3$-(Me)$_{10}$, and wherein nucleosides of said first strand comprise a 2' sugar modification pattern as follows (5'-3'):

Me-F-(Me)$_3$-X$_1$-(Me)$_7$-F-Me-F-(Me)$_7$, wherein $X_1$ is a thermally destabilising modification.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar modification pattern as follows (5'-3'):

(Me)$_8$-(F)$_3$-(Me)$_{10}$, and wherein nucleosides of said first strand comprise a 2' sugar modification pattern as follows (5'-3'):

(Me-F)$_3$-(Me)$_7$-F-Me-F-(Me)$_7$.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar modification pattern as follows (5'-3'):

(Me)$_8$-(F)$_3$-(Me)$_{10}$, and wherein nucleosides of said first strand comprise a 2' sugar modification pattern as follows (5'-3'):

Me-F-(Me)$_3$-F-(Me)$_7$-(F-Me)$_2$-F-(Me)$_5$.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar modification pattern as follows (5'-3'):

(Me)$_8$-(F)$_3$-(Me)$_{10}$, and wherein nucleosides of said first strand comprise a 2' sugar modification pattern as follows (5'-3'):

Me-F-(Me)$_3$-F-(Me)$_7$-F-Me-F-(Me)$_3$-F-(Me)$_3$.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar modification pattern as follows (5'-3'):

(Me)$_8$-(F)$_3$-(Me)$_{10}$, and wherein nucleosides of said first strand comprise a 2' sugar modification pattern as follows (5'-3'):

Me-F-(Me)$_3$-X$_1$-Me-(F)$_2$-(Me)$_4$-F-Me-F-(Me)$_7$, wherein $X_1$ is a thermally destabilising modification.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar modification pattern as follows (5'-3'):

(Me)$_8$-(F)$_3$-(Me)$_{10}$, and wherein nucleosides of said first strand comprise a 2' sugar modification pattern as follows (5'-3'):

(Me-F)$_3$-Me-(F)$_2$-(Me)$_4$-(F-Me)$_2$-(Me)$_6$.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar modification pattern as follows (5'-3'):

(Me)$_8$-(F)$_3$-(Me)$_{10}$, and wherein nucleosides of said first strand comprise a 2' sugar modification pattern as follows (5'-3'):

Me-F-(Me)$_3$-F-Me-(F)$_2$-(Me)$_4$-(F-Me)$_2$-F-(Me)$_5$.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar modification pattern as follows (5'-3'):

$(Me)_8$-$(F)_3$-$(Me)_{10}$, and wherein nucleosides of said first strand comprise a 2' sugar modification pattern as follows (5'-3'):

$$Me\text{-}F\text{-}(Me)_3\text{-}F\text{-}Me\text{-}(F)_2\text{-}(Me)_4\text{-}(F\text{-}Me)_2\text{-}(Me)_2\text{-}F\text{-}(Me)_3.$$

A nucleic acid wherein the second strand comprises a 2' sugar, and abasic modification pattern as follows (5'-3'):

$$ia\text{-}ia\text{-}(Me)_8\text{-}(F)_3\text{-}(Me)_{10}$$

wherein ia represents an inverted abasic nucleoside.

A nucleic acid wherein the second strand comprises a 2' sugar, and abasic modification pattern as follows (5'-3'):

ia-ia-$(Me)_8$-$(F)_3$-$(Me)_{10}$, wherein ia represents an inverted abasic nucleoside; and wherein the first strand comprises a 2' sugar modification pattern wherein said modifications are selected at least from 2'Me and 2'F sugar modifications, provided that the overall number of 2'F sugar modifications in the first strand does not consist of four, or six, 2'F modifications.

A nucleic acid wherein the second strand comprises a 2' sugar, and abasic modification pattern as follows (5'-3'):

ia-ia-$(Me)_8$-$(F)_3$-$(Me)_{10}$, wherein ia represents an inverted abasic nucleoside; and wherein the first strand comprises a 2' sugar modification pattern wherein said modifications are selected at least from 2'Me and 2'F sugar modifications, wherein the overall number of 2'F sugar modifications in the first strand consists of three, five or seven 2'F modifications.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-$(Me)_8$-$(F)_3$-$(Me)_{10}$, wherein ia represents an inverted abasic nucleoside; and wherein nucleosides of said first strand comprise a 2' sugar modification pattern as follows (5'-3'):

Me-F-$(Me)_3$-$X_1$-$(Me)_7$-F-Me-F-$(Me)_7$, wherein $X_1$ is a thermally destabilising modification.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-$(Me)_8$-$(F)_3$-$(Me)_{10}$, wherein ia represents an inverted abasic nucleoside; and wherein nucleosides of said first strand comprise a 2' sugar modification pattern as follows (5'-3'):

$$(Me\text{-}F)_3\text{-}(Me)_7\text{-}F\text{-}Me\text{-}F\text{-}(Me)_7.$$

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-$(Me)_8$-$(F)_3$-$(Me)_{10}$, wherein ia represents an inverted abasic nucleoside; and wherein nucleosides of said first strand comprise a 2' sugar modification pattern as follows (5'-3'):

$$Me\text{-}F\text{-}(Me)_3\text{-}F\text{-}(Me)_7\text{-}(F\text{-}Me)_2\text{-}F\text{-}(Me)_5.$$

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-$(Me)_8$-$(F)_3$-$(Me)_{10}$, wherein ia represents an inverted abasic nucleoside; and wherein nucleosides of said first strand comprise a 2' sugar modification pattern as follows (5'-3'):

$$Me\text{-}F\text{-}(Me)_3\text{-}F\text{-}(Me)_7\text{-}F\text{-}Me\text{-}F\text{-}(Me)_3\text{-}F\text{-}(Me)_3.$$

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-$(Me)_8$-$(F)_3$-$(Me)_{10}$, wherein ia represents an inverted abasic nucleoside; and wherein nucleosides of said first strand comprise a 2' sugar modification pattern as follows (5'-3'):

$$Me\text{-}F\text{-}(Me)_3\text{-}X_1\text{-}Me\text{-}(F)_2\text{-}(Me)_4\text{-}F\text{-}Me\text{-}F\text{-}(Me)_7,$$

wherein $X_1$ is a thermally destabilising modification.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-$(Me)_8$-$(F)_3$-$(Me)_{10}$, wherein ia represents an inverted abasic nucleoside; and wherein nucleosides of said first strand comprise a 2' sugar modification pattern as follows (5'-3'):

(Me-F)$_3$-Me-(F)$_2$-(Me)$_4$-(F-Me)$_2$-(Me)$_6$.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-(Me)$_8$-(F)$_3$-(Me)$_{10}$, wherein ia represents an inverted abasic nucleoside; and wherein nucleosides of said first strand comprise a 2' sugar modification pattern as follows (5'-3'):

Me-F-(Me)$_3$-F-Me-(F)$_2$-(Me)$_4$-(F-Me)$_2$-F-(Me)$_5$.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-(Me)$_8$-(F)$_3$-(Me)$_{10}$, wherein ia represents an inverted abasic nucleoside; and wherein nucleosides of said first strand comprise a 2' sugar modification pattern as follows (5'-3'):

Me-F-(Me)$_3$-F-Me-(F)$_2$-(Me)$_4$-(F-Me)$_2$-(Me)$_2$-F-(Me)$_3$.

A nucleic acid wherein the second strand comprises a 2' sugar modification pattern as follows (5'-3'):

ia-ia-Me(s)Me(s) (Me)$_6$-(F)$_3$-(Me)$_{10}$, wherein ia represents an inverted abasic nucleoside, and (s) represents a phosphorothioate linkage.

A nucleic acid wherein the second strand comprises a 2' sugar modification pattern as follows (5'-3'):

ia-ia-Me(s)Me(s) (Me)$_6$-(F)$_3$-(Me)$_{10}$, wherein ia represents an inverted abasic nucleoside, and (s) represents a phosphorothioate linkage; and wherein the first strand comprises a 2' sugar modification pattern wherein said modifications are selected at least from 2'Me and 2'F sugar modifications, provided that the overall number of 2'F sugar modifications in the first strand does not consist of four, or six, 2'F modifications.

A nucleic acid wherein the second strand comprises a 2' sugar modification pattern as follows (5'-3'):

ia-ia-Me(s)Me(s) (Me)$_6$-(F)$_3$-(Me)$_{10}$, wherein ia represents an inverted abasic nucleoside, and (s) represents a phosphorothioate linkage; and wherein the first strand comprises a 2' sugar modification pattern wherein said modifications are selected at least from 2'Me and 2'F sugar modifications, wherein the overall number of 2'F sugar modifications in the first strand consists of three, five or seven 2'F modifications.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-Me(s)Me(s) (Me)$_6$-(F)$_3$-(Me)$_{10}$, wherein ia represents an inverted abasic nucleoside, and (s) represents a phosphorothioate linkage, and wherein nucleosides of said first strand comprise a 2' sugar modification pattern as follows (5'-3'):

Me(s)F(s)(Me)$_3$-$X_1$-(Me)$_7$-F-Me-F-(Me)s(s)Me(s)Me, wherein $X_1$ is a thermally destabilising modification.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-Me(s)Me(s) (Me)$_6$-(F)$_3$-(Me)$_{10}$, wherein ia represents an inverted abasic nucleoside, and (s) represents a phosphorothioate linkage, and wherein nucleosides of said first strand comprise a 2' sugar modification pattern as follows (5'-3'):

Me(s)F(s)Me-F-Me-F-(Me)$_7$-F-Me-F-(Me)$_5$(s)Me(s)Me.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-Me(s)Me(s) (Me)$_6$-(F)$_3$-(Me)$_{10}$, wherein ia represents an inverted abasic nucleoside, and (s) represents a phosphorothioate linkage, and wherein nucleosides of said first strand comprise a 2' sugar modification pattern as follows (5'-3'):

Me(s)F(s) (Me)$_3$-F-(Me)$_7$-(F-Me)$_2$-F-(Me)$_3$(s)Me(s)Me.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-Me(s)Me(s) (Me)$_6$-(F)$_3$-(Me)$_{10}$, wherein ia represents an inverted abasic nucleoside, and (s) represents a phosphorothioate linkage, and wherein nucleosides of said first strand comprise a 2' sugar modification pattern as follows (5'-3'):

Me(s)F(s) (Me)$_3$-F-(Me)$_7$-F-Me-F-(Me)$_3$-F-Me(s)Me(s)Me.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-Me(s)Me(s) $(Me)_6$-$(F)_3$-$(Me)_{10}$, wherein ia represents an inverted abasic nucleoside, and (s) represents a phosphorothioate linkage, and wherein nucleosides of said first strand comprise a 2' sugar modification pattern as follows (5'-3'):

Me(s)F(s)$(Me)_3$-$X_1$-Me-$(F)_2$-$(Me)_4$-F-Me-F-$(Me)_5$(s)Me(s)Me, wherein $X_1$ is a thermally destabilising modification.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-Me(s)Me(s) $(Me)_6$-$(F)_3$-$(Me)_{10}$, wherein ia represents an inverted abasic nucleoside, and (s) represents a phosphorothioate linkage, and wherein nucleosides of said first strand comprise a 2' sugar modification pattern as follows (5'-3'):

Me(s)F(s)Me-F-Me-F-Me-$(F)_2$-$(Me)_4$-$(F\text{-}Me)_2$-$(Me)_4$(s)Me(s)Me.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-Me(s)Me(s) $(Me)_6$-$(F)_3$-$(Me)_{10}$, wherein ia represents an inverted abasic nucleoside, and (s) represents a phosphorothioate linkage, and wherein nucleosides of said first strand comprise a 2' sugar modification pattern as follows (5'-3'):

Me(s)F(s)$(Me)_3$-F-Me-$(F)_2$-$(Me)_4$-$(F\text{-}Me)_2$-F-$(Me)_3$(s)Me(s)Me.

A nucleic acid comprising a first strand that is at least partially complementary to a portion of RNA transcribed from the target gene, and a second strand that is at least partially complementary to the first strand, wherein said first and second strands form a duplex region of at least 17 nucleosides in length, and wherein nucleosides of said second strand comprise a 2' sugar, and abasic modification pattern as follows (5'-3'):

ia-ia-Me(s)Me(s) $(Me)_6$-$(F)_3$-$(Me)_{10}$, wherein ia represents an inverted abasic nucleoside, and (s) represents a phosphorothioate linkage, and wherein nucleosides of said first strand comprise a 2' sugar modification pattern as follows (5'-3'):

Me(s)F(s)$(Me)_3$-F-Me-$(F)_2$-$(Me)_4$-$(F\text{-}Me)_2$-$(Me)_2$-F-Me(s)Me(s)Me.

Preferred modifications are as follows:

Modification pattern 1:
Second strand (5'-3'):
ia-ia-Me-Me-Me-Me-Me-Me-Me-Me-F-F-F-Me-
Me-Me-Me-Me-Me-Me-Me-Me-Me-Me, First strand (5'-3'):
Me-F-Me-Me-Me-$X_1$-Me-Me-Me-Me-Me-Me-Me-F-
Me-F-Me-Me-Me-Me-Me-Me-Me, wherein $X_1$ is a thermally destabilising modification;
Or Modification pattern 2:
Second strand (5'-3'):
ia-ia-Me-Me-Me-Me-Me-Me-Me-Me-F-F-F-Me-
Me-Me-Me-Me-Me-Me-Me-Me-Me-Me, First strand (5'-3'):
Me-F-Me-F-Me-F-Me-Me-Me-Me-Me-Me-Me-F-Me-
F-Me-Me-Me-Me-Me-Me-Me,
Or Modification pattern 3:
Second strand (5'-3'):
ia-ia-Me-Me-Me-Me-Me-Me-Me-Me-F-F-F-Me-
Me-Me-Me-Me-Me-Me-Me-Me-Me-Me, First strand (5'-3'): M-F-Me-Me-Me-F-Me-Me-Me-Me-Me-Me-Me-F-
Me-F-Me-F-Me-Me-Me-Me-Me;
Or Modification pattern 4:
Second strand (5'-3'):
ia-ia-Me-Me-Me-Me-Me-Me-Me-Me-F-F-F-Me-
Me-Me-Me-Me-Me-Me-Me-Me-Me-Me, First strand (5'-3'):
Me-F-Me-Me-Me-F-Me-Me-Me-Me-Me-Me-Me-F-
Me-F-Me-Me-Me-F-Me-Me-Me;

-continued

Or

Modification pattern 5:
Second strand (5'-3'):
ia-ia-Me-Me-Me-Me-Me-Me-Me-Me-F-F-F-Me-Me-Me-Me-Me-Me-Me-Me-Me-Me, First strand (5'-3'):
Me-F-Me-Me-Me-$X_1$-Me-F-F-Me-Me-Me-Me-F-Me-F-Me-Me-Me-Me-Me-Me-Me, wherein $X_1$ is a thermally destabilising modification;
Or Modification pattern 6:
Second strand (5'-3'):
ia-ia-Me-Me-Me-Me-Me-Me-Me-Me-F-F-F-Me-Me-Me-Me-Me-Me-Me-Me-Me-Me, First strand (5'-3'):
Me-F-Me-F-Me-F-Me-F-F-Me-Me-Me-Me-F-Me-F-Me-Me-Me-Me-Me-Me-Me;
Or Modification pattern 7:
Second strand (5'-3'):
ia-ia-Me-Me-Me-Me-Me-Me-Me-Me-F-F-F-Me-Me-Me-Me-Me-Me-Me-Me-Me-Me, First strand (5'-3'):
Me-F-Me-Me-Me-F-Me-F-F-Me-Me-Me-Me-F-Me-F-Me-F-Me-Me-Me-Me-Me;
Or Modification pattern 8:
Second strand (5'-3'):
ia-ia-Me-Me-Me-Me-Me-Me-Me-Me-F-F-F-Me-Me-Me-Me-Me-Me-Me-Me-Me-Me, First strand (5'-3'):
Me-F-Me-Me-Me-F-Me-F-F-Me-Me-Me-Me-F-Me-F-Me-Me-Me-F-Me-Me-Me.

Particularly preferred modifications are as follows:
Modification pattern 1:
Second strand (5'-3'):
ia-ia-Me(s)Me(s)Me-Me-Me-Me-Me-Me-F-F-F-Me-Me-Me-Me-Me-Me-Me-Me-Me-Me, First strand (5'-3'):
Me(s)F(s)Me-Me-Me-$X_1$-Me-Me-Me-Me-Me-Me-Me-F-Me-F-Me-Me-Me-Me-Me(s)Me(s)Me, wherein $X_1$ is a thermally destabilising modification;
Or Modification pattern 2:
Second strand (5'-3'):
ia-ia-Me(s)Me(s)Me-Me-Me-Me-Me-Me-F-F-F-Me-Me-Me-Me-Me-Me-Me-Me-Me-Me, First strand (5'-3'):
Me(s)F(s)Me-F-Me-F-Me-Me-Me-Me-Me-Me-Me-F-Me-F-Me-Me-Me-Me-Me(s)Me(s)Me;
Or Modification pattern 3:
Second strand (5'-3'):
ia-ia-Me(s)Me(s)Me-Me-Me-Me-Me-Me-F-F-F-Me-Me-Me-Me-Me-Me-Me-Me-Me-Me, First strand (5'-3'):
Me(s)F(s)Me-Me-Me-F-Me-Me-Me-Me-Me-Me-Me-F-Me-F-Me-F-Me-Me-Me(s)Me(s)Me;
Or Modification pattern 4:
Second strand (5'-3'):
ia-ia-Me(s)Me(s)Me-Me-Me-Me-Me-Me-F-F-F-Me-Me-Me-Me-Me-Me-Me-Me-Me-Me, -continued

```
First strand (5'-3'):
Me(s)F(s)Me-Me-Me-F-Me-Me-Me-Me-Me-Me-Me-F-
Me-F-Me-Me-Me-F-Me(s)Me(s)Me;
Or

Modification pattern 5:
Second strand (5'-3'):
ia-ia-Me(s)Me(s)Me-Me-Me-Me-Me-Me-F-F-F-Me-
Me-Me-Me-Me-Me-Me-Me-Me-Me,

First strand (5'-3'):
Me(s)F(s)Me-Me-Me-X1-Me-F-F-Me-Me-Me-Me-F-Me-
F-Me-Me-Me-Me-Me(s)Me(s)Me, wherein X1 is a thermally destabilising
modification;
Or

Modification pattern 6:
Second strand (5'-3'):
ia-ia-Me(s)Me(s)Me-Me-Me-Me-Me-Me-F-F-F-Me-
Me-Me-Me-Me-Me-Me-Me-Me-Me,

First strand (5'-3'):
Me(s)F(s)Me-F-Me-F-Me-F-F-Me-Me-Me-Me-F-Me-
F-Me-Me-Me-Me-Me(s)Me(s)Me;
Or

Modification pattern 7:
Second strand (5'-3'):
ia-ia-Me(s)Me(s)Me-Me-Me-Me-Me-Me-F-F-F-Me-
Me-Me-Me-Me-Me-Me-Me-Me-Me,

First strand (5'-3'):
Me(s)F(s)Me-Me-Me-F-Me-F-F-Me-Me-Me-Me-F-Me-
F-Me-F-Me-Me-Me(s)Me(s)Me;
Or

Modification pattern 8:
Second strand (5'-3'):
ia-ia-Me(s)Me(s)Me-Me-Me-Me-Me-Me-F-F-F-Me-
Me-Me-Me-Me-Me-Me-Me-Me-Me,

First strand (5'-3'):
Me(s)F(s)Me-Me-Me-F-Me-F-F-Me-Me-Me-Me-F-Me-
F-Me-Me-Me-F-Me(s)Me(s)Me;
```

wherein (s) is a phosphorothioate internucleoside linkage.

Conjugation of Nucleic Acid to Ligand

Another modification of a nucleic acid e.g. RNA e.g. an siRNA of the invention involves linking the nucleic acid e.g. the siRNA to one or more ligand moieties e.g. to enhance the activity, cellular distribution, or cellular uptake of the nucleic acid e.g. siRNA e.g., into a cell.

In some embodiments, the ligand moiety described can be attached to a nucleic acid e.g. an siRNA oligonucleoside, via a linker that can be cleavable or non-cleavable. The term "linker" or "linking group" means an organic moiety that connects two parts of a compound, e.g., covalently attaches two parts of a compound.

The ligand can be attached to the 3' or 5' end of the sense strand.

The ligand is preferably conjugated to 3' end of the sense strand of the nucleic acid e.g. an siRNA agent.

The invention therefore relates in a further aspect to a conjugate for inhibiting expression of a target e.g. a target gene, in a cell, said conjugate comprising a nucleic acid portion and one or more ligand moieties, said nucleic acid portion comprising a nucleic acid as disclosed herein.

In one aspect the second strand of the nucleic acid is conjugated directly or indirectly (e.g. via a linker) to the one or more ligand moiety(s), wherein said ligand moiety is typically present at a terminal region of the second strand, preferably at the 3' terminal region thereof.

In certain embodiments, the ligand moiety comprises a GalNAc or GalNAc derivative attached to the nucleic acid e.g. dsiRNA through a linker.

Therefore, the invention relates to a conjugate wherein the ligand moiety comprises i) one or more GalNAc ligands; and/or
ii) one or more GalNAc ligand derivatives; and/or
iii) one or more GalNAc ligands conjugated to said nucleic acid through a linker.

Said GalNAc ligand may be conjugated directly or indirectly to the 5' or 3' terminal region of the second strand of the nucleic acid, preferably at the 3' terminal region thereof.

GalNAc ligands are well known in the art and described in, inter alia, EP3775207A1.

In some embodiments, the ligand moiety comprises one or more ligands.

In some embodiments, the ligand moiety comprises one or more carbohydrate ligands.

In some embodiments, the one or more carbohydrates can be a monosaccharide, disaccharide, trisaccharide, tetrasaccharide, oligosaccharide and/or polysaccharide.

In some embodiments, the one or more carbohydrates comprise one or more galactose moieties, one or more lactose moieties, one or more N-AcetylGalactosamine moieties, and/or one or more mannose moieties.

In some embodiments, the one or more carbohydrates comprise one or more N-Acetyl-Galactosamine moieties.

In some embodiments, the compounds as described anywhere herein comprise two or three N-AcetylGalactosamine moieties.

In some embodiments, the one or more ligands are attached in a linear configuration, or in a branched configuration, for example each configuration being respectively attached to a branch point in an overall linker.

Figure 1A:
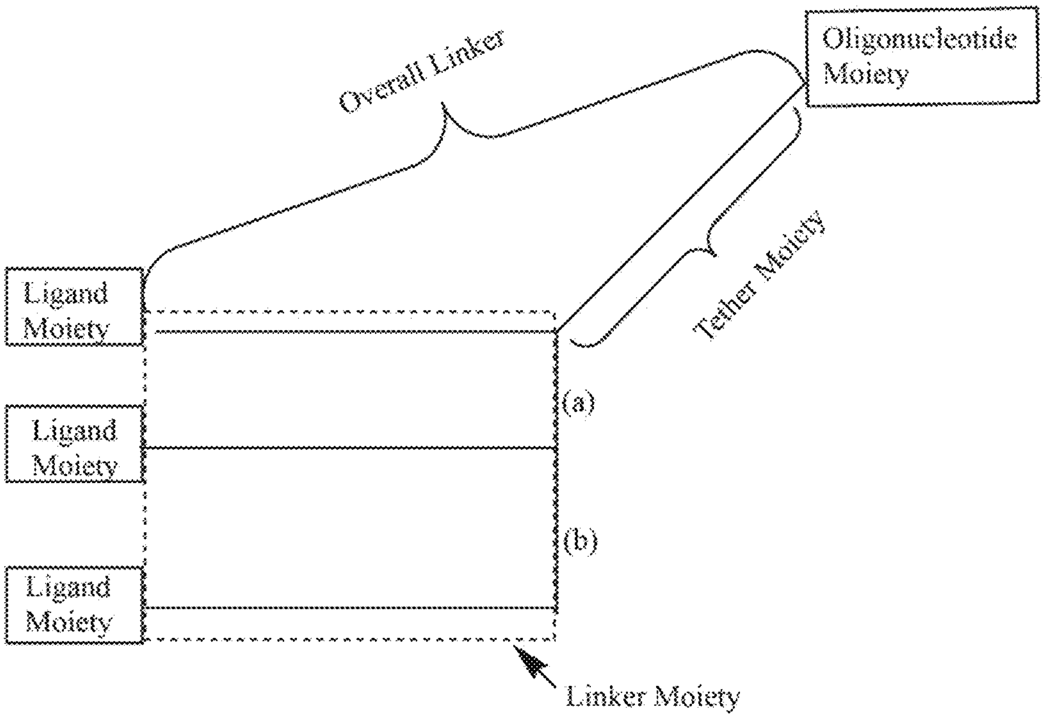
FIG. 1A shows an exemplary linear configuration for a conjugate.
Figure 1B:
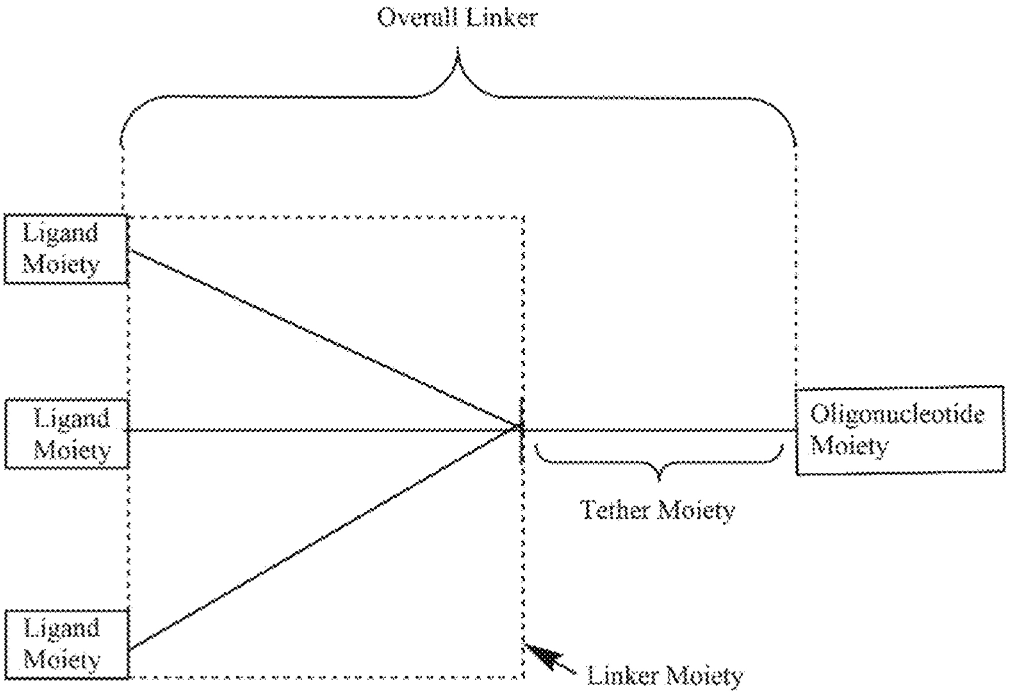
FIG. 1B shows an exemplary branched configuration for a conjugate.
Figure 2:
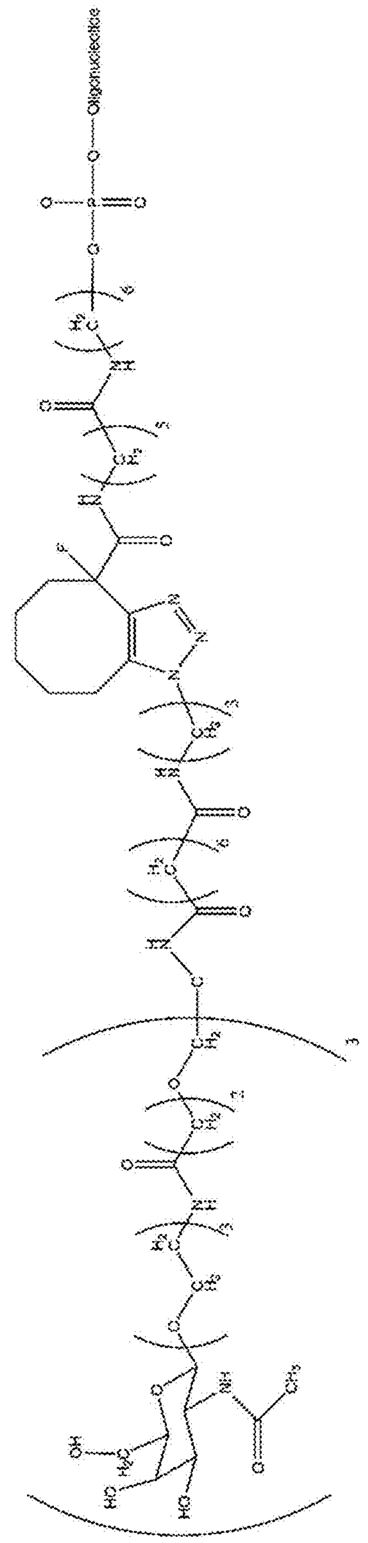
FIGS. 2-5 show preferred oligomer—linker—ligand constructs of the invention.
Figure 3:
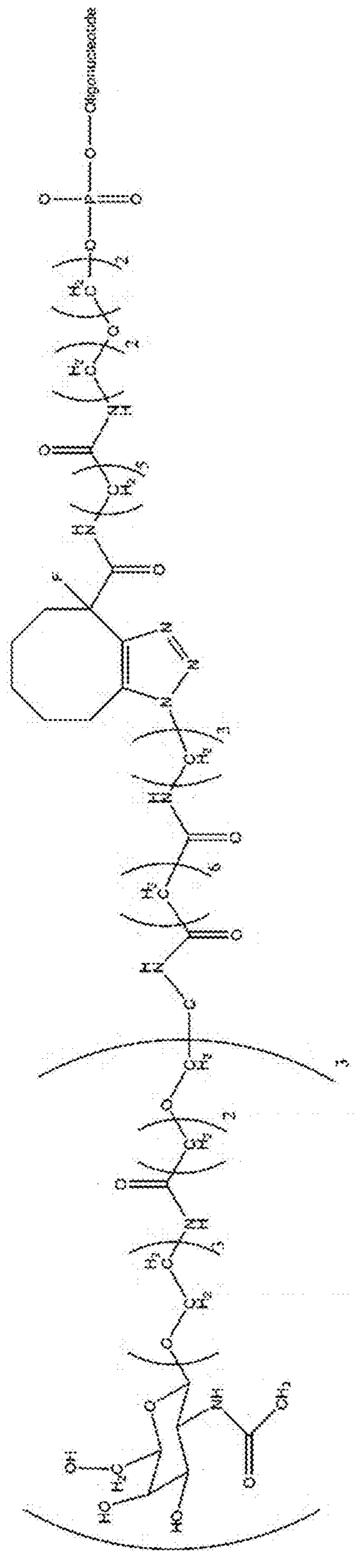
Figure 4:
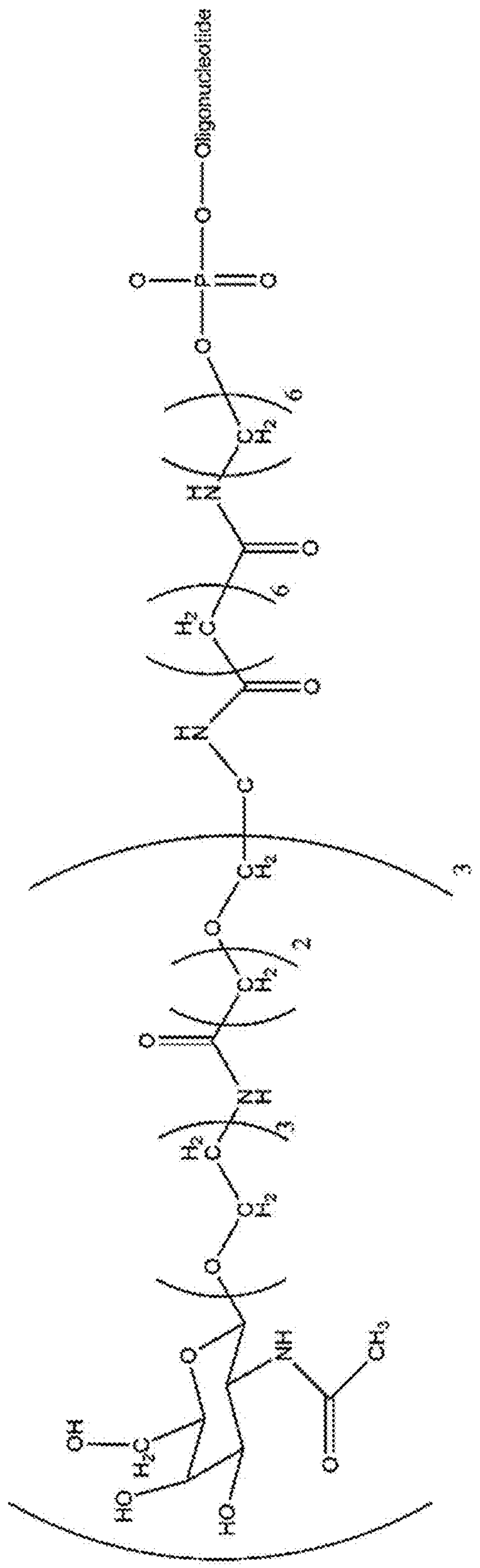
Figure 5:
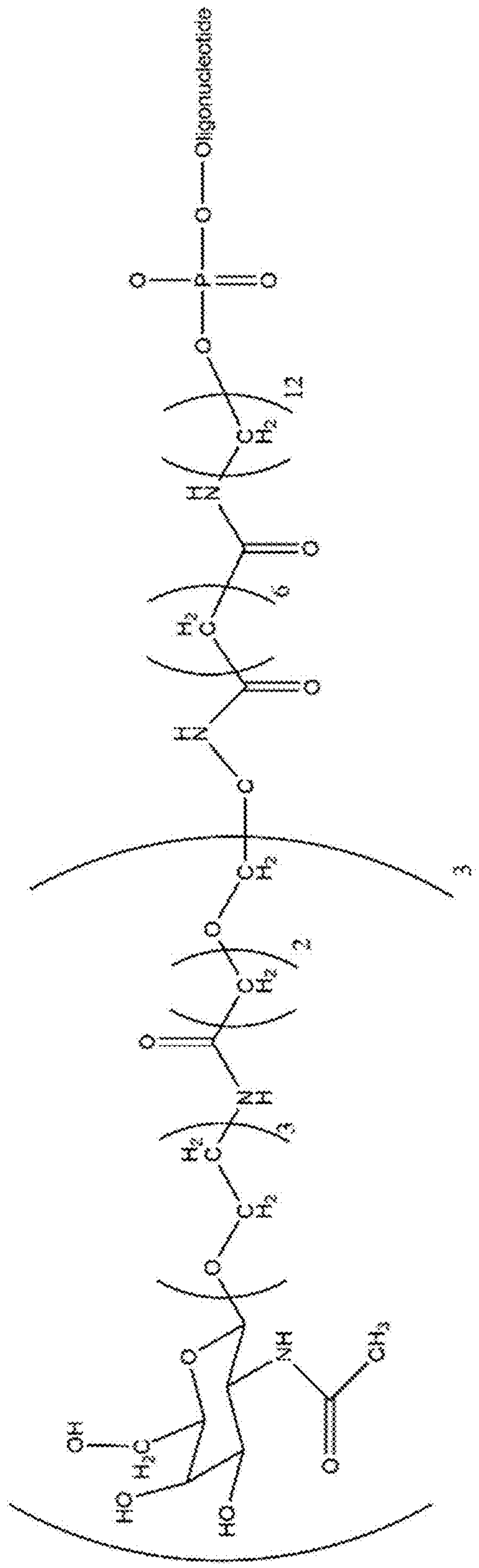

Exemplary linear configurations and Exemplary branched configurations are shown in FIG. 1A-B:

In FIG. 1A, (linear), (a) and/or (b) can typically represent connecting bonds or groups, such as phosphate or phosphorothioate groups.

In FIG. 1B, (branched), in some embodiments, the one or more ligands are attached as a biantennary or triantennary branched configuration. Typically, a triantennary branched configuration can be preferred, such as an N-AcetylGalactosamine triantennary branched configuration.

Linker

Exemplary compounds of the invention comprise a 'linker moiety', such as that as depicted in Formula (I), that is part of an overall 'linker'.

point, that is often referred to as the 'tether moiety' of the overall linker, 'tethering' the oligonucleoside moiety to the remainder of the conjugated compound. Such 'ligand arms' and/or 'linker moieties' and/or 'tether moieties' can be envisaged by reference to the linear and/or branched configurations as set out above.

As can be seen from the claims, and the reminder of the patent specification, the scope of the present invention extends to linear or branched configurations, and with no limitation as to the number of individual ligands that might be present. Furthermore, the addressee will also be aware that there are many structures that could be used as the linker moiety, based on the state of the art and the expertise of an oligonucleoside chemist.

The remainder of the overall linker (other than the linker moiety) as set out in the claims, and the remainder of the patent specification, is shown by its chemical constituents in Formula (I), which the inventors consider to be particularly unique to the current invention. In more general terms, however, these chemical constituents could be described as Formula I

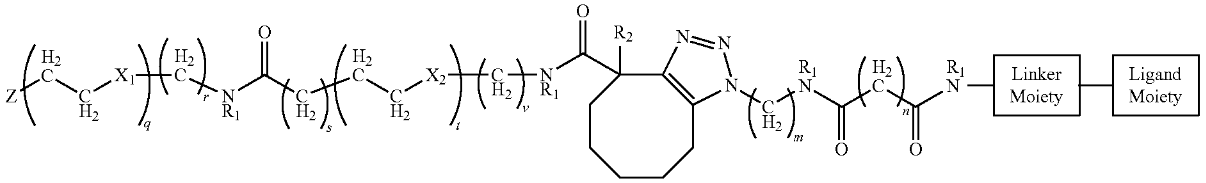

wherein:

$R_1$ at each occurrence is independently selected from the group consisting of hydrogen, methyl and ethyl;

$R_2$ is selected from the group consisting of hydrogen, hydroxy, —$OC_{1-3}$alkyl, —C(=O)$OC_{1-3}$alkyl, halo and nitro;

$X_1$ and $X_2$ at each occurrence are independently selected from the group consisting of methylene, oxygen and sulfur;

m is an integer of from 1 to 6;

n is an integer of from 1 to 10;

q, r, s, t, v are independently integers from 0 to 4, with the proviso that:

(i) q and r cannot both be 0 at the same time; and (ii) s, t and v cannot all be 0 at the same time;

Z is an oligonucleoside moiety.

As will be further understood in the art, exemplary compounds of the invention comprise an overall linker that is located between the oligonucleoside moiety and the ligand moiety of these compounds. The overall linker, thereby 'links' the oligonucleoside moiety and the ligand moiety to each other.

The overall linker is often notionally envisaged as comprising one or more linker building blocks. For example, there is a linker portion that is depicted as the 'linker moiety' as represented in Formula (I) positioned adjacent the ligand moiety and attaching the ligand moiety, typically via a branch point, directly or indirectly to the oligonucleoside moiety. The linker moiety as depicted in Formula (I) can also often be referred to as the 'ligand arm or arms' of the overall linker. There can also, but not always, be a further linker portion between the oligonucleoside moiety and the branch a 'tether moiety' as hereinbefore described, wherein the 'tether moiety' is that portion of the overall linker which comprises the group of atoms between Z, namely the oligonucleoside moiety, and the linker moiety as depicted in Formula (I).

Tether Moiety of Formula I

In relation to Formula (I), the 'tether moiety' comprises the group of atoms between Z, namely the oligonucleoside moiety, and the linker moiety.

In some embodiments, $R_1$ is hydrogen at each occurrence. In some embodiments, $R_1$ is methyl. In some embodiments, $R_1$ is ethyl.

In some embodiments, $R_2$ is hydroxy. In some embodiments, $R_2$ is halo. In some embodiments, $R_2$ is fluoro. In some embodiments, $R_2$ is chloro. In some embodiments, $R_2$ is bromo. In some embodiments, $R_2$ is iodo. In some embodiments, $R_2$ is nitro.

In some embodiments, $X_1$ is methylene. In some embodiments, $X_1$ is oxygen. In some embodiments, $X_1$ is sulfur.

In some embodiments, $X_2$ is methylene. In some embodiments, $X_2$ is oxygen. In some embodiments, $X_2$ is sulfur.

In some embodiments, m=3.

In some embodiments, n=6.

In some embodiments, $X_1$ is oxygen and $X_2$ is methylene. In some embodiments, both $X_1$ and $X_2$ are methylene.

In some embodiments, q=1, r=2, s=1, t=1, v=1. In some embodiments, q=1, r =3, s=1, t=1, v=1.

In some embodiments, $R_1$ is hydrogen at each occurrence, n=6, m=3, $R_2$ is fluoro, $X_2$ is methylene, v=1, t=1, s=1, $X_1$ is methylene, q=1 and r=2.

Thus, in some embodiments, exemplary compounds of the invention comprise the following structure:

Formula (IV)

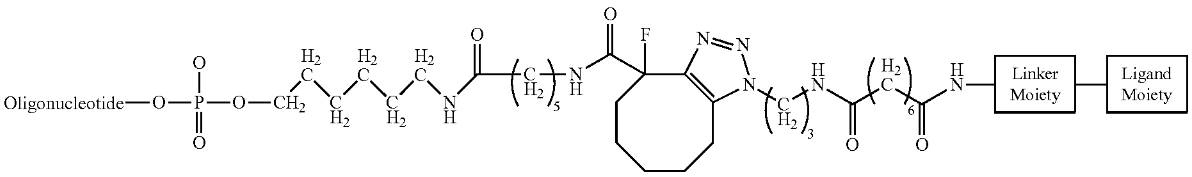

In some embodiments, $R_1$ is hydrogen at each occurrence, n=6, m=3, $R_2$ is fluoro, $X_2$ is methylene, v=1, t=1, s=1, $X_1$ is oxygen, q=1 and r=2.

Thus, in some embodiments, exemplary compounds of the invention comprise the following structure:

Formula (II)

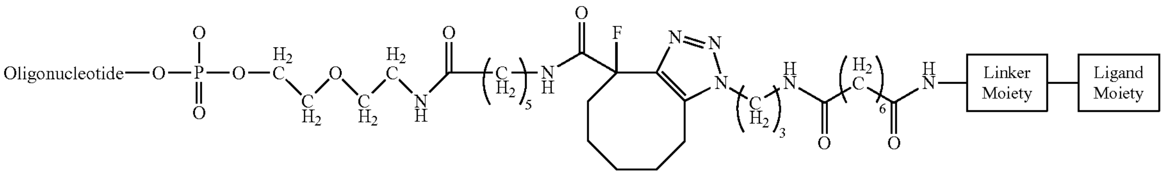

Alternative Tether Moieties

During the synthesis of compounds of the present invention, alternative tether moiety structures may arise. In some embodiments, alternative tether moieties have a change of one or more atoms in the tether moiety of the overall linker compared to tether moieties described anywhere herein.

In some embodiments, the alternative tether moiety is a compound of Formula (I) as described anywhere herein, wherein $R_2$ is hydroxy.

In some embodiments, $R_1$ is hydrogen at each occurrence, n=6, m=3, $R_2$ is hydroxy, $X_2$ is methylene, v=1, t=1, s=1, $X_1$ is methylene, q=1 and r=2.

Thus, in some embodiments, compounds of the invention comprise the following structure:

Formula (V)

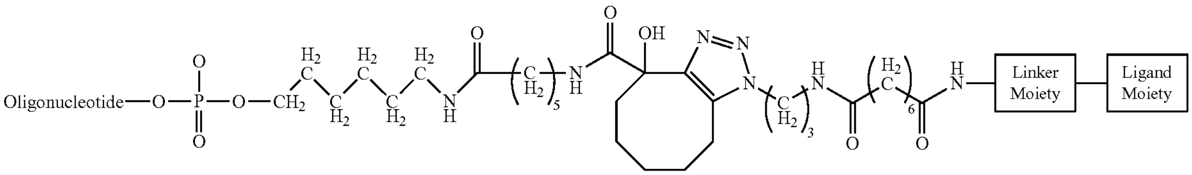

In some embodiments, $R_1$ is hydrogen at each occurrence, n=6, m=3, $R_2$ is hydroxy, $X_2$ is methylene, v=1, t=1, s=1, $X_1$ is oxygen, q=1 and r=2.

Thus, in some embodiments, compounds of the invention comprise the following structure:

Formula (III)

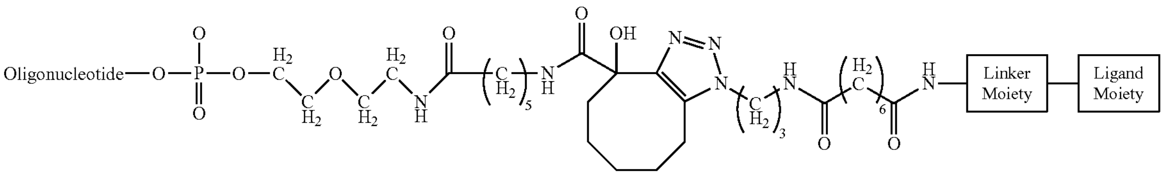

Linker Moiety

In relation to Formula (I), the 'linker moiety' as depicted in Formula (I) comprises the group of atoms located between the tether moiety as described anywhere herein, and the ligand moiety as described anywhere herein.

In some embodiments:

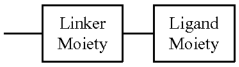

as depicted in Formula (I) as described anywhere herein is any of Formulae (VIa), (VIb) or (VIc), preferably Formula (VIa):

Formula (VIa)

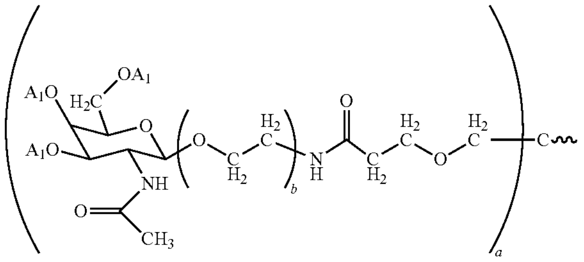

wherein:

$A_1$ is hydrogen, or a suitable hydroxy protecting group;

a is an integer of 2 or 3; and b is an integer of 2 to 5; or

Formula (VIb)

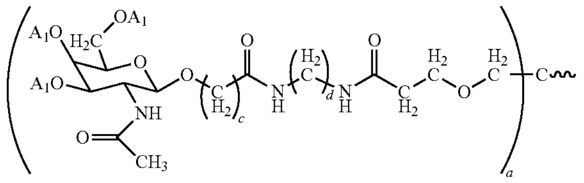

wherein:

$A_1$ is hydrogen, or a suitable hydroxy protecting group;

a is an integer of 2 or 3; and c and d are independently integers of 1 to 6; or

Formula (VIc)

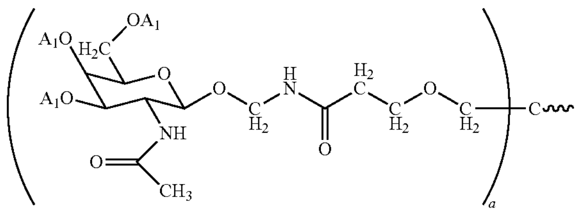

wherein:

$A_1$ is hydrogen, or a suitable hydroxy protecting group;

a is an integer of 2 or 3; and e is an integer of 2 to 10.

In some embodiments, the moiety:

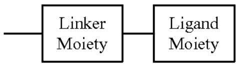

as depicted in Formula (I) is Formula (VIa):

Formula (VIa)

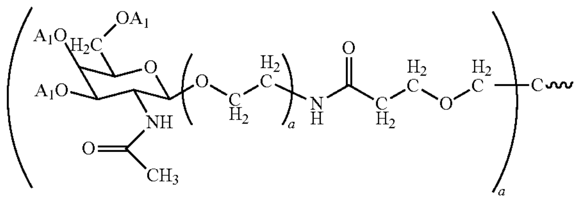

wherein:

$A_1$ is hydrogen, or a suitable hydroxy protecting group;

a is 3; and b is an integer of 3.

In some embodiments, the moiety:

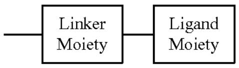

as depicted in Formula (I) as described anywhere herein is Formula (VII):

Formula (VII)

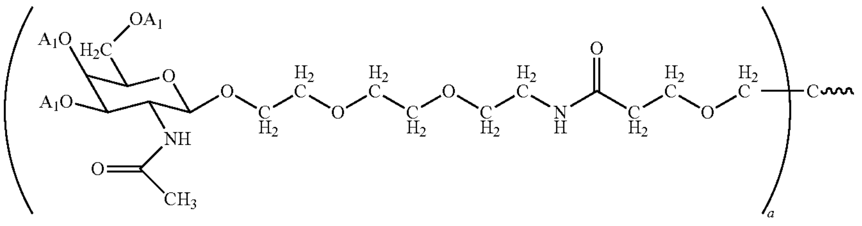

wherein:

$A_1$ is hydrogen;

a is an integer of 2 or 3, preferably 3.

Other exemplary compounds of the invention comprise a 'linker moiety', as depicted in Formula (I*), that is part of an overall 'linker'.

Formula I*

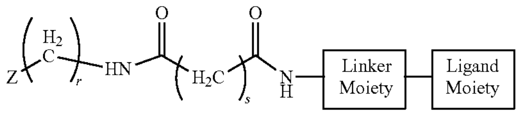

Where:

r and s are independently an integer selected from 1 to 16; and

Z is an oligonucleoside moiety.

As will be further understood in the art, exemplary compounds of the invention comprise an overall linker that is located between the oligonucleoside moiety and the ligand moiety of these compounds. The overall linker, thereby 'links' the oligonucleoside moiety and the ligand moiety to each other.

The overall linker is often notionally envisaged as comprising one or more linker building blocks. For example, there is a linker portion that is depicted as the 'linker moiety' as represented in Formula (I*) positioned adjacent the ligand moiety and attaching the ligand moiety, typically via a branch point, directly or indirectly to the oligonucleoside moiety. The linker moiety as depicted in Formula (I*) can also often be referred to as the 'ligand arm or arms' of the overall linker. There can also, but not always, be a further linker portion between the oligonucleoside moiety and the branch point, that is often referred to as the 'tether moiety' of the overall linker, 'tethering' the oligonucleoside moiety to the remainder of the conjugated compound. Such 'ligand arms' and/or 'linker moieties' and/or 'tether moieties' can be envisaged by reference to the linear and/or branched configurations as set out above.

As can be seen from the claims, and the reminder of the patent specification, the scope of the present invention extends to linear or branched configurations, and with no limitation as to the number of individual ligands that might be present. Furthermore, the addressee will also be aware that there are many structures that could be used as the linker moiety, based on the state of the art and the expertise of an oligonucleoside chemist.

The remainder of the overall linker (other than the linker moiety) as set out in the claims, and the remainder of the patent specification, is shown by its chemical constituents in Formula (I), which the inventors consider to be particularly unique to the current invention. In more general terms, however, these chemical constituents could be described as a 'tether moiety' as hereinbefore described, wherein the 'tether moiety' is that portion of the overall linker which comprises the group of atoms between Z, namely the oligonucleoside moiety, and the linker moiety as depicted in Formula (I).

Tether Moiety

In relation to Formula (I*), the 'tether moiety' comprises the group of atoms between Z, namely the oligonucleoside moiety, and the linker moiety.

In some embodiments, s is an integer selected from 4 to 12. In some embodiments, s is 6.

In some embodiments, r is an integer selected from 4 to 14. In some embodiments, r is 6. In some embodiments, r is 12.

In some embodiments, r is 12 and s is 6.

Thus, in some embodiments, exemplary compounds of the invention comprise the following structure:

Formula (II*)

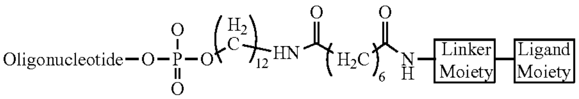

In some embodiments, r is 6 and s is 6.

Thus, in some embodiments, exemplary compounds of the invention comprise the following structure:

Formula (III*)

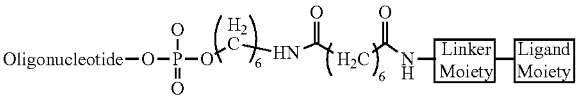

Linker Moiety

In relation to Formula (I*), the 'linker moiety' as depicted in Formula (I) comprises the group of atoms located between the tether moiety as described anywhere herein, and the ligand moiety as described anywhere herein.

In some embodiments, the moiety:

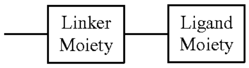

as depicted in Formula (I*) as described anywhere herein is any of Formulae (IV*), (V*) or (VI*), preferably Formula (IV*):

Formula (IV*)

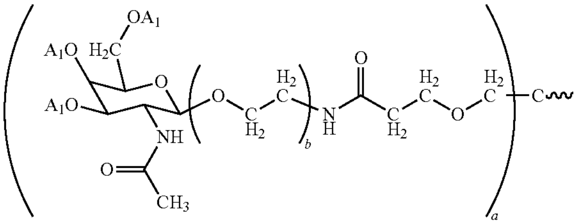

wherein:

$A_1$ is hydrogen, or a suitable hydroxy protecting group;

a is an integer of 2 or 3; and b is an integer of 2 to 5; or

Formula (V*)

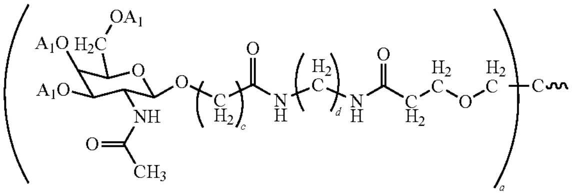

wherein:

$A_1$ is hydrogen, or a suitable hydroxy protecting group;

a is an integer of 2 or 3; and c and d are independently integers of 1 to 6; or

Formula (VI*)

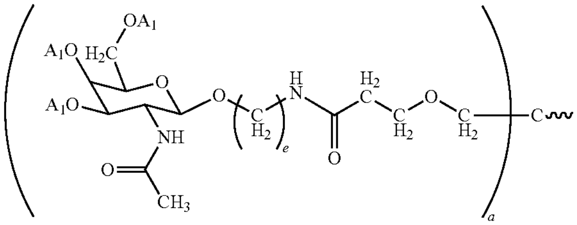

wherein:

$A_1$ is hydrogen, or a suitable hydroxy protecting group;

a is an integer of 2 or 3; and e is an integer of 2 to 10.

In some embodiments, the moiety:

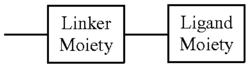

as depicted in Formula (I) is Formula (VIa*):

Formula (VIa*)

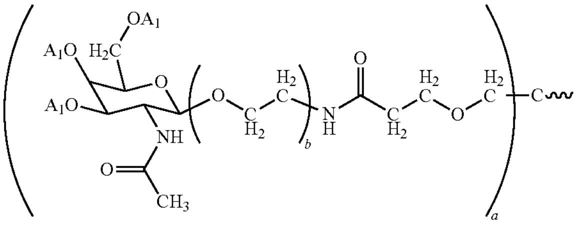

wherein:

$A_1$ is hydrogen, or a suitable hydroxy protecting group;

a is 3; and b is an integer of 3.

In some embodiments, the moiety:

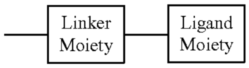

as depicted in Formula (I) as described anywhere herein is Formula (VII*):

Formula (VII*)

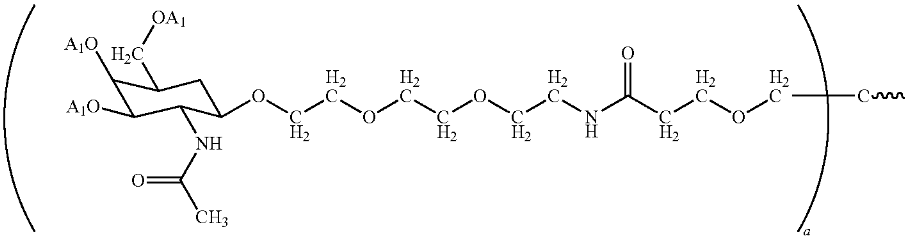

wherein:

$A_1$ is hydrogen;

a is an integer of 2 or 3.

In some embodiments, a=2. In some embodiments, a=3. In some embodiments, b=3.

Vector and Cell

In one aspect, the invention provides a cell containing a nucleic acid, such as inhibitory RNA [RNAi] as described herein.

In one aspect, the invention provides a cell comprising a vector as described herein.

In one aspect the invention provides a vector comprising an oligonucleotide inhibitor, e.g. an iRNA e.g. siRNA.

Pharmaceutically Acceptable Compositions

In one aspect, the invention provides a pharmaceutical composition for inhibiting expression of a target gene, the composition comprising an inhibitor such as an oligomer such as a nucleic acid as disclosed herein.

The pharmaceutically acceptable composition may comprise an excipient and or carrier.

Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or poly anhydrides; (22) bulking agents, such as polypeptides and amino acids (23) serum component, such as serum albumin, HDL and LDL; and (22) other non-toxic compatible substances employed in pharmaceutical formulations.

Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable excipients include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone, and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

In one embodiment, the nucleic acid or composition is administered in an unbuffered solution. In certain embodiments, the unbuffered solution is saline or water. In other embodiments, the nucleic acid e.g. RNAi agent is administered in a buffered solution. In such embodiments, the buffer solution can comprise acetate, citrate, prolamine, carbonate, or phosphate, or any combination thereof. For example, the buffer solution can be phosphate buffered saline (PBS).

Dosages

The pharmaceutical compositions of the invention may be administered in dosages sufficient to inhibit expression of a gene or modify the expression or function of a target such as an LNCRNA. In general, where the composition comprising a nucleic acid, a suitable dose of a nucleic acid e.g. an siRNA of the invention will be in the range of about 0.001 to about 200.0 milligrams per kilogram body weight of the recipient per day, generally in the range of about 1 to 50 mg per kilogram body weight per day. Typically, a suitable dose of a nucleic acid e.g. an siRNA of the invention will be in the range of about 0.1 mg/kg to about 5.0 mg/kg, e.g., about 0.3 mg/kg and about 3.0 mg/kg.

A repeat-dose regimen may include administration of a therapeutic amount of a nucleic acid e.g. siRNA on a regular basis, such as every other day or once a year. In certain embodiments, the nucleic acid e.g. siRNA is administered about once per month to about once per quarter (i.e., about once every three months).

In various embodiments, the nucleic acid e.g. siRNA agent is administered at a dose of about 0.01 mg/kg to about 10 mg/kg or about 0.5 mg/kg to about 50 mg/kg. In some embodiments, the nucleic acid e.g. siRNA agent is administered at a dose of about 10 mg/kg to about 30 mg/kg. In certain embodiments, the nucleic acid e.g. siRNA agent is administered at a dose selected from about 0.5 mg/kg 1 mg/kg, 1.5 mg/kg, 3 mg/kg, 5 mg/kg, 10 mg/kg, and 30 mg/kg. In certain embodiments, the nucleic acid e.g. siRNA agent is administered about once per week, once per month, once every other two months, or once a quarter (i.e., once every three months) at a dose of about 0.1 mg/kg to about 5.0 mg/kg. In certain embodiments, the nucleic acid e.g. siRNA agent is administered to the subject once a week. In certain embodiments, the nucleic acid e.g. siRNA agent is administered to the subject once a month. In certain embodiments, the nucleic acid e.g. siRNA agent is administered once per quarter (i.e., every three months).

After an initial treatment regimen, the treatments can be administered on a less frequent basis. For example, after administration weekly or biweekly for three months, administration can be repeated once per month, for six months, or a year; or longer.

The pharmaceutical composition can be administered once daily, or administered as two, three, or more sub-doses at appropriate intervals throughout the day or even using continuous infusion or delivery through a controlled release formulation. In that case, the nucleic acid e.g. siRNA contained in each sub-dose must be correspondingly smaller in order to achieve the total daily dosage. The dosage unit can also be compounded for delivery over several days, e.g., using a conventional sustained release formulation which provides sustained release of the nucleic acid e.g. siRNA over a several day period. Sustained release formulations are well known in the art and are particularly useful for delivery of agents at a particular site, such as could be used with the agents of the present invention. In this embodiment, the dosage unit contains a corresponding multiple of the daily dose.

In other embodiments, a single dose of the pharmaceutical compositions can be long lasting, such that subsequent doses are administered at not more than 3, 4, or 5 day intervals, or at not more than 1, 2, 3, or 4 week intervals. In some embodiments of the invention, a single dose of the pharmaceutical compositions of the invention is administered once per week. In other embodiments of the invention, a single dose of the pharmaceutical compositions of the invention is administered bimonthly. In certain embodiments, the siRNA is administered about once per month to about once per quarter (i.e., about once every three months), or even every 6 months or 12 months.

Estimates of effective dosages and in vivo half-lives for the individual nucleic acid e.g. siRNAs encompassed by the invention can be made using conventional methodologies or on the basis of in vivo testing using an appropriate animal model, as known in the art.

The pharmaceutical compositions of the present invention can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal, or intramuscular injection or infusion; subdermal, e.g., via an implanted device; or intracranial, e.g., by intraparenchymal, intrathecal or intraventricular administration. In certain preferred embodiments, the compositions are administered by intravenous infusion or injection. In certain embodiments, the compositions are administered by subcutaneous injection.

In one embodiment, the nucleic acid e.g. siRNA agent is administered to the subject subcutaneously.

The inhibitor e.g. nucleic acid e.g. siRNA can be delivered in a manner to target a particular tissue (e.g. in particular liver cells).

Methods for Inhibiting Gene Expression or Inhibition of Target Expression or Function The present invention also provides methods of inhibiting expression of a gene in a cell and methods for inhibiting expression and/or function of other target molecules such as LNCRNA. The methods include contacting a cell with a nucleic acid of the invention e.g. siRNA agent, such as double stranded siRNA agent, in an amount effective to inhibit expression of the gene in the cell, thereby inhibiting expression of the gene in the cell. In a preferred embodiment, the gene encodes an enzyme that is involved in post-translational glycosylation. In a more preferred embodiment, the gene is B4GALT1.

Contacting of a cell with the inhibitor e.g. the nucleic acid e.g. an siRNA, such as a double stranded siRNA agent, may be done in vitro or in vivo. Contacting a cell in vivo with the inhibitor nucleic acid e.g. siRNA includes contacting a cell or group of cells within a subject, e.g., a human subject, with the nucleic acid e.g. siRNA. Combinations of in vitro and in vivo methods of contacting a cell are also possible. Contacting a cell may be direct or indirect, as discussed above. Furthermore, contacting a cell may be accomplished via a targeting ligand moiety, including any ligand moiety described herein or known in the art. In preferred embodiments, the targeting ligand moiety is a carbohydrate moiety, e.g. a GalNAc3 ligand, or any other ligand moiety that directs the siRNA agent to a site of interest.

The term “inhibiting,” as used herein, is used interchangeably with “reducing,” “silencing,” “downregulating”, “suppressing”, and other similar terms, and includes any level of inhibition.

In some embodiments of the methods of the invention, expression or activity of a gene or an inhibition target such as a LNCRNA is inhibited by at least 30%, 35%, 40%, 45%, 50%, 55%, 60%, 65%, 70%, 75%, 80%, 85%, 90%, or 95%, or to below the level of detection of the assay, preferably when determined by qPCR as described herein and/or when the siRNA is introduced into the target cell by transfection. In certain embodiments, the methods include a clinically relevant inhibition of expression of a target gene e.g. as demonstrated by a clinically relevant outcome after treatment of a subject with an agent to reduce the expression of the gene and/or activity of the target.

In some embodiments, when transfected into the cells, the nucleic acid of the invention inhibits expression of the B4GALT1 gene with an IC50 value lower than 2500 pM, 2400 pM, 2300 pM, 2200 pM, 2100 pM, 2000 pM, 1900 pM, 1800 pM, 1700 pM, 1600 pM, 1500 pM, 1400 pM, 1300 pM, 1200 pM, 1100 pM, 1000 pM, 900 pM, 800 pM, 700 pM, 600 pM, 500 pM, 400 pM, 300 pM, 200 pM or 100 pM, preferably when determined by qPCR, more preferably by reverse transcriptase (RT)-qPCR, as described herein.

In a preferred embodiment, when transfected into the cells, the nucleic acid of the invention inhibits expression of the B4GALT1 gene with an IC50 value lower than 2500 pM. In a more preferred embodiment, when transfected into the cells, the nucleic acid of the invention inhibits expression of the B4GALT1 gene with an IC50 value lower than 1000 pM. In an even more preferred embodiment, when transfected into the cells, the nucleic acid of the invention inhibits expression of the B4GALT1 gene with an IC50 value lower than 500 pM. In a most preferred embodiment, when transfected into the cells, the nucleic acid of the invention inhibits expression of the B4GALT1 gene with an IC50 value lower than 100 pM.

Inhibition of expression of the B4GALT1 gene may be quantified using the following method:

Huh7 cells (human hepatocyte-derived cell line, obtained from JCRB Cell Bank) may be maintained in Dulbecco’s Modified Eagle Medium (DMEM) supplemented with 10% FBS at 37° C. in an atmosphere of 5% CO2. Cells may then be transfected with siRNA duplexes targeting B4GALT1 mRNA or a negative control siRNA (siRNA-control; sense strand 5'-UUCUCCGAACGUGUCACGUTT-3' (SEQ ID NO:623), antisense strand 5'-ACGUGACACGUUCGGAGAATT-3' (SEQ ID NO:622)) using 10×3-fold serial dilutions over a final duplex concentration range of 20 nM to 1 pM. Transfection may be carried out by adding 9.7 μL Opti-MEM (ThermoFisher) plus 0.3 μL Lipofectamine RNAiMAX (ThermoFisher) to 10 μL of each siRNA duplex. The mixture may be incubated at room temperature for 15 minutes before being added to 100 μL of complete growth medium containing 20,000 Huh7 cells. Cells may be incubated for 24 hours at 37° C./5% CO2 prior to total RNA purification using a RNeasy 96 Kit (Qiagen). Each duplex may be tested by transfection in duplicate wells in a single experiment.

cDNA synthesis may be performed using FastQuant RT (with gDNase) Kit (Tiangen). Real-time quantitative PCR (qPCR) may be performed on an ABI Prism 7900HT or ABI QuantStudio 7 with primers specific for human B4GALT1 (Hs00155245_m1) and human GAPDH (Hs02786624_g1) using a TaqMan Gene Expression Assay Kit (ThermoFisher Scientific).

qPCR may be performed in duplicate on cDNA derived from each well and the mean cycle threshold (Ct) calculated. Relative B4GALT1 expression may be calculated from mean Ct values using the comparative Ct (ΔΔCt) method, normalised to GAPDH and relative to untreated cells. Maximum percent inhibition of B4GALT1 expression and IC50 values may be calculated using a four parameter (variable slope) model using GraphPad Prism 9.

Alternatively or in addition, the inhibitory potential of a nucleic acid of the invention may be quantified without prior transfection of a target cell with said nucleic acid.

Thus, in some embodiments, when cells are incubated with a nucleic acid of the invention, the nucleic acid of the invention inhibits expression of the B4GALT1 gene with an EC50 value lower than 1000 nM, 900 nM, 800 nM, 700 nM, 600 nM, 500 nM, 400 nM, 300 nM, 200 nM, or 100 nM, preferably when determined by qPCR, more preferably by reverse transcriptase (RT)-qPCR, as described herein.

In a preferred embodiment, when cells are incubated with a nucleic acid of the invention, the nucleic acid of the invention inhibits expression of the B4GALT1 gene with an EC50 value lower than 1000 nM. In a more preferred embodiment, when cells are incubated with a nucleic acid of the invention, the nucleic acid of the invention inhibits expression of the B4GALT1 gene with an EC50 value lower than 500 nM. In an even more preferred embodiment, when cells are incubated with a nucleic acid of the invention, the nucleic acid of the invention inhibits expression of the B4GALT1 gene with an EC50 value lower than 200 nM. In a most preferred embodiment, when cells are incubated with a nucleic acid of the invention, the nucleic acid of the invention inhibits expression of the B4GALT1 gene with an EC50 value lower than 100 nM.

Inhibition of expression of the B4GALT1 gene in the presence of free nucleic acids may be quantified using the following method:

Primary C57BL/6 mouse hepatocytes (PMHs) may be isolated fresh by two-step collagenase liver perfusion. Cells may be maintained in DMEM (Gibco-11995-092) supplemented with FBS, Penicillin/Streptomycin, HEPES and L-glutamine. Cells may be cultured at 37° C. in an atmosphere with 5% $CO_2$ in a humidified incubator. Within 2 hours post isolation, PMHs may be seeded at a density of 36,000 cells/well in regular 96-well tissue culture plates. Dose response analysis in PMHs may be done by direct incubation of cells in a gymnotic free uptake setting with final GalNAc-siRNA concentrations of 1000, 500, 250, 125, 62.5, 31.3, 15.6, 7.8, 3.9, 1.95 nM. In control wells, cells may be incubated without GalNAc-siRNA. After 48 hr incubation, cells may be harvested for RNA extraction. Total RNA may be extracted using RNeasy Kit following the manufacturer's instructions (Qiagen, Shanghai, China). After reverse transcription, real-time quantitative PCR may be performed using an ABI Prism 7900HT to detect the relative abundance of B4GALT1 mRNA normalized to the housekeeping gene GAPDH. The expression of the target gene in each test sample may be determined by relative quantitation using the comparative Ct (ΔΔCt) method. This method measures the Ct differences (ΔCt) between target gene and housekeeping gene. The formula is as follows: ΔCt=average Ct of B4GALT1-average Ct of GAPDH, ΔΔCt=ΔCt (sample)−average ΔCt (untreated control), relative expression of target gene mRNA=$2^{-\Delta\Delta Ct}$.

Alternatively or in addition, inhibition of expression of the B4GALT1 gene may be characterized by a reduction of mean relative expression of the B4GALT1 gene.

In some embodiments, when cells are transfected with 0.1 nM of the nucleic acid of the invention, the mean relative expression of B4GALT1 is below 1, 0.9, 0.8, 0.7, 0.6, 0.5, or 0.4, preferably when determined by qPCR, more preferably by reverse transcriptase (RT)-qPCR, as described herein.

In some embodiments, when cells are transfected with 5 nM of the nucleic acid of the invention, the mean relative expression of B4GALT1 is below 1, 0.9, 0.8, 0.7, 0.6, 0.5, 0.4 or 0.3, preferably when determined by qPCR, more preferably by reverse transcriptase (RT)-qPCR, as described herein.

Mean relative expression of the B4GALT1 gene may be quantified using the following method:

Huh7 cells (human hepatocyte-derived cell line, obtained from JCRB Cell Bank) may be maintained in Dulbecco's Modified Eagle Medium (DMEM) supplemented with 10% FBS at 37° C. in at atmosphere of 5% $CO_2$. Cells may be transfected with siRNA duplexes targeting B4GALT1 mRNA or a negative control siRNA (siRNA-control; sense strand 5'-UUCUCCGAACGUGUCACGUTT-3'(SEQ ID NO:623), antisense strand 5'-ACGUGACACGUUCG-GAGAATT-3' (SEQ ID NO:622)) at a final duplex concentration of 5 nM and 0.1 nM. Transfection may be carried out by adding 9.7 μL Opti-MEM (ThermoFisher) plus 0.3 μL Lipofectamine RNAiMAX (ThermoFisher) to 10 μL of each siRNA duplex. The mixture may be incubated at room temperature for 15 minutes before being added to 100 μL of complete growth medium containing 20,000 Huh7 cells. Cells may be incubated for 24 hours at 37° C./5% $CO_2$ prior to total RNA purification using a RNeasy 96 Kit (Qiagen). Each duplex may be tested by transfection in duplicate wells in two independent experiments.

cDNA synthesis may be performed using FastQuant RT (with gDNase) Kit (Tiangen). Real-time quantitative PCR (qPCR) may be performed on an ABI Prism 7900HT or ABI QuantStudio 7 with primers specific for human B4GALT1 (Hs00155245_m1) and human GAPDH (Hs02786624_g1) using a TaqMan Gene Expression Assay Kit (ThermoFisher Scientific).

qPCR may be performed in duplicate on cDNA derived from each well and the mean Ct calculated. Relative B4GALT1 expression may be calculated from mean Ct values using the comparative Ct (ΔΔCt) method, normalised to GAPDH and relative to untreated cells Inhibition of the expression of a gene may be manifested by a reduction of the amount of mRNA of the target gene of interest in comparison to a suitable control. Inhibition of the function of a target may be manifested by a reduction of the activity of the target in comparison to a suitable control.

In other embodiments, inhibition of the expression of a gene or other target may be assessed in terms of a reduction of a parameter that is functionally linked to gene expression, e.g, protein expression or signalling pathways.

Methods of Treating or Preventing Diseases Associated with Gene Expression/Expression of Function of a Target e.g. LCNRNA The present invention also provides methods of using nucleic acid e.g. an siRNA of the invention or a composition containing nucleic acid e.g. an siRNA of the invention to reduce or inhibit gene expression in a cell or reduce expression or function of a target. The methods include contacting the cell with a nucleic acid e.g. dsiRNA of the invention and maintaining the cell for a time sufficient to obtain degradation of the mRNA transcript of a gene, thereby inhibiting expression of the gene in the cell. Reduction in gene expression or function of a target can be assessed by any methods known in the art. In a preferred embodiment, the gene encodes an enzyme that is involved in post-translational glycosylation. In a more preferred embodiment, the gene is B4GALT1.

In the methods of the invention the cell may be contacted in vitro or in vivo, i.e., the cell may be within a subject.

A cell suitable for treatment using the methods of the invention may be any cell that expresses a gene of interest or target of interest associated with disease.

The in vivo methods of the invention may include administering to a subject a composition containing a nucleic acid of the invention e.g. an siRNA, where the nucleic acid e.g. siRNA includes a nucleoside sequence that is complementary to at least a part of an RNA transcript of the gene of the mammal to be treated, or complementary to another nucleic acid the expression and/or function of which is associated with diseases.

The present invention further provides methods of treatment of a subject in need thereof. The treatment methods of the invention include administering a nucleic acid such as an siRNA of the invention to a subject, e.g., a subject that would benefit from a reduction or inhibition of the expression of a gene and/or expression and/or function of a target, in a therapeutically effective amount e.g. a nucleic acid such as an siRNA targeting a gene or a pharmaceutical composition comprising the nucleic acid targeting a gene.

A nucleic acid e.g. siRNA of the invention may be administered as a "free" nucleic acid or "free" siRNA, administered in the absence of a pharmaceutical composition. The naked nucleic acid may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution can be adjusted such that it is suitable for administering to a subject.

Alternatively, a nucleic acid e.g. siRNA of the invention may be administered as a pharmaceutical composition, such as a dsiRNA liposomal formulation.

In one embodiment, the method includes administering a composition featured herein such that expression of the target gene is decreased, such as for about 1, 2, 3, 4, 5, 6, 7, 8, 12, 16, 18, 24 hours, 28, 32, or about 36 hours. In one embodiment, expression of the target gene is decreased for an extended duration, e.g., at least about two, three, four days or more, e.g., about one week, two weeks, three weeks, or four weeks or longer, e.g., about 1 month, 2 months, or 3 months.

Subjects can be administered a therapeutic amount of nucleic acid e.g. siRNA, such as about 0.01 mg/kg to about 200 mg/kg.

The nucleic acid e.g. siRNA can be administered by intravenous infusion over a period of time, on a regular basis. In certain embodiments, after an initial treatment regimen, the treatments can be administered on a less frequent basis. Administration of the siRNA can reduce gene product levels of a target gene, e.g., in a cell or tissue of the patient by at least about 20%, 25%, 30%, 35%, 40%, 45%, 50%, 55%, 60%, 65%, 70%, 75%, 80%, 85%, 90%, or 95%, or below the level of detection of the assay method used. In certain embodiments, administration results in clinical stabilization or preferably clinically relevant reduction of at least one sign or symptom of a gene-associated disorder.

Alternatively, the nucleic acid e.g. siRNA can be administered subcutaneously, i.e., by subcutaneous injection. One or more injections may be used to deliver the desired daily dose of nucleic acid e.g. siRNA to a subject. The injections may be repeated over a period of time. The administration may be repeated on a regular basis. In certain embodiments, after an initial treatment regimen, the treatments can be administered on a less frequent basis. A repeat-dose regimen may include administration of a therapeutic amount of nucleic acid on a regular basis, such as every other day or to once a year. In certain embodiments, the nucleic acid is administered about once per month to about once per quarter (i.e., about once every three months).

In one aspect the present invention may be applied in the compounds, processes, compositions or uses of the following Sentences numbered 1-101 (wherein reference to any Formula in the Sentences 1-101 refers only to those Formulas that are defined within Sentences 1-101. These formulae are reproduced in FIG. 6)

1. A compound comprising the following structure:

Formula (I)

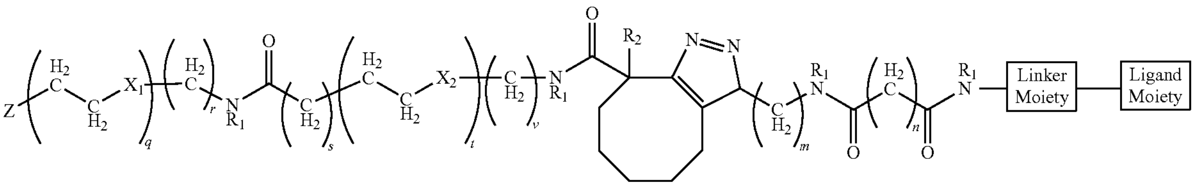

wherein:

$R_1$ at each occurrence is independently selected from the group consisting of hydrogen, methyl and ethyl;

$R_2$ is selected from the group consisting of hydrogen, hydroxy, —$OC_{1-3}$alkyl, —C(═O)$OC_{1-3}$alkyl, halo and nitro;

$X_1$ and $X_2$ at each occurrence are independently selected from the group consisting of methylene, oxygen and sulfur;

m is an integer of from 1 to 6;

n is an integer of from 1 to 10;

q, r, s, t, v are independently integers from 0 to 4, with the proviso that:

(i) q and r cannot both be 0 at the same time; and (ii) s, t and v cannot all be 0 at the same time;

Z is an oligonucleoside moiety.

2. A compound according to Sentence 1, wherein $R_1$ is hydrogen at each occurrence.
3. A compound according to Sentence 1, wherein $R_1$ is methyl.
4. A compound according to Sentence 1, wherein $R_1$ is ethyl.
5. A compound according to any of Sentences 1 to 4, wherein $R_2$ is hydroxy.
6. A compound according to any of Sentences 1 to 4, wherein $R_2$ is halo.

7. A compound according to Sentence 6, wherein $R_2$ is fluoro.
8. A compound according to Sentence 6, wherein $R_2$ is chloro.
9. A compound according to Sentence 6, wherein $R_2$ is bromo.
10. A compound according to Sentence 6, wherein $R_2$ is iodo.
11. A compound according to Sentence 6, wherein $R_2$ is nitro.
12. A compound according to any of Sentences 1 to 11, wherein $X_1$ is methylene.
13. A compound according to any of Sentences 1 to 11, wherein $X_1$ is oxygen.
14. A compound according to any of Sentences 1 to 11, wherein $X_1$ is sulfur.
15. A compound according to any of Sentences 1 to 14, wherein $X_2$ is methylene.
16. A compound according to any of Sentences 1 to 15, wherein $X_2$ is oxygen.
17. A compound according to any of Sentences 1 to 16, wherein $X_2$ is sulfur.
18. A compound according to any of Sentences 1 to 17, wherein m=3.
19. A compound according to any of Sentences 1 to 18, wherein n=6.
20. A compound according to Sentences 13 and 15, wherein $X_1$ is oxygen and $X_2$ is methylene, and preferably wherein:
q=1,
r=2,
s=1,
t=1,
v=1.

22. A compound according to any of Sentences 1 to 21, wherein Z is:

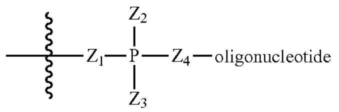

wherein:

$Z_1$, $Z_2$, $Z_3$, $Z_4$ are independently at each occurrence oxygen or sulfur; and one the bonds between P and $Z_2$, and P and $Z_3$ is a single bond and the other bond is a double bond.

23. A compound according to Sentence 22, wherein said oligonucleoside is an RNA compound capable of modulating, preferably inhibiting, expression of a target gene.
24. A compound according to Sentence 23, wherein said RNA compound comprises an RNA duplex comprising first and second strands, wherein the first strand is at least partially complementary to an RNA sequence of a target gene, and the second strand is at least partially complementary to said first strand, and wherein each of the first and second strands have 5' and 3' ends.
25. A compound according to Sentence 24, wherein the RNA compound is attached at the 5' end of its second strand to the adjacent phosphate.
26. A compound according to Sentence 24, wherein the RNA compound is attached at the 3' end of its second strand to the adjacent phosphate.
27. A compound of Formula (II):

Formula (II)

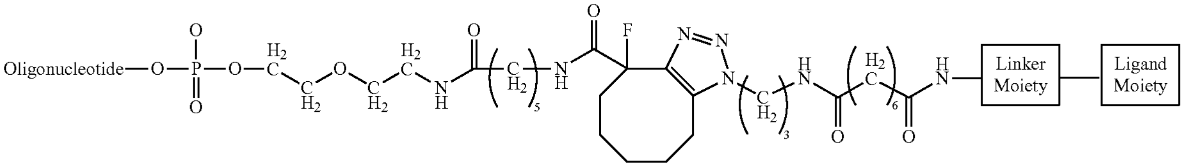

28. A compound of Formula (III):

Formula (III)

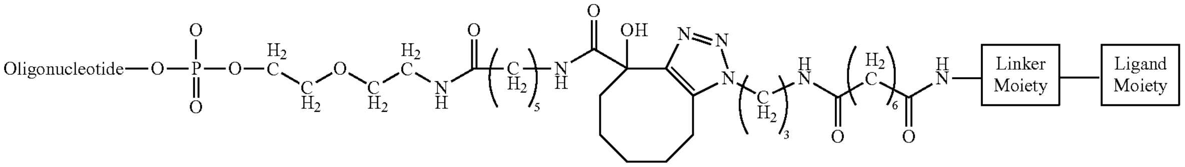

21. A compound according to Sentences 12 and 15, wherein both $X_1$ and $X_2$ are methylene, and preferably wherein:
q=1,
r=3,
s=1,
t=1,
v=1.

29. A compound according to Sentence 27 or 28, wherein the oligonucleoside comprises an RNA duplex comprising first and second strands, wherein the first strand is at least partially complementary to an RNA sequence of a target gene, and the second strand is at least partially complementary to said first strand, and wherein each of the first and second strands have 5' and 3' ends, and wherein said RNA duplex is attached at the 5' end of its second strand to the adjacent phosphate.

30. A composition comprising a compound of Formula (II) as defined in Sentence 27, and a compound of Formula (III) as defined in Sentence 28, optionally dependent on Sentence 29.

31. A composition according to Sentence 30, wherein said compound of Formula (III) as defined in Sentence 28 is present in an amount in the range of 10 to 15% by weight of said composition.

32. A compound of Formula (IV):

38. A compound according to Sentence 37, wherein the modifications are chosen from 2'-O-methyl, 2'-deoxy-fluoro, and 2'-deoxy.

39. A compound according to any of Sentences 1 to 29, or 32 to 34, or 37 to 38, wherein the oligonucleoside further comprises one or more degradation protective moieties at one or more ends.

40. A compound according to Sentence 39, wherein said one or more degradation protective moieties are not present at the end of the oligonucleoside strand that carries the ligand moieties, and/or wherein said one or Formula (IV)

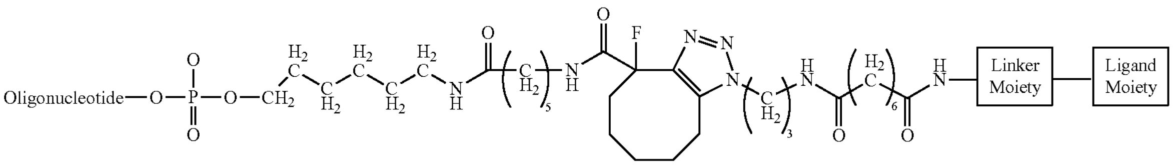

33. A compound of Formula (V):

Formula (V)

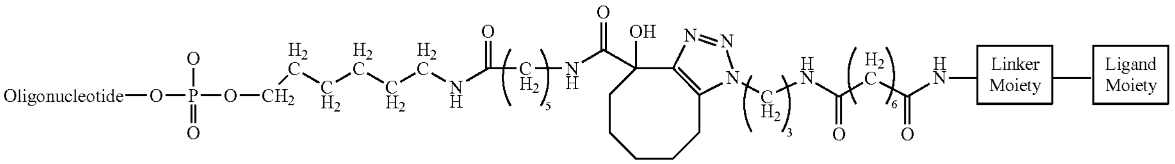

34. A compound according to Sentence 32 or 33, wherein the oligonucleoside comprises an RNA duplex comprising first and second strands, wherein the first strand is at least partially complementary to an RNA sequence of a target gene, and the second strand is at least partially complementary to said first strand, and wherein each of the first and second strands have 5' and 3' ends, and wherein said RNA duplex is attached at the 3' end of its second strand to the adjacent phosphate.

35. A composition comprising a compound of Formula (IV) as defined in Sentence 32, and a compound of Formula (V) as defined in Sentence 33, optionally dependent on Sentence 34.

36. A composition according to Sentence 35, wherein said compound of Formula (V) as defined in Sentence 33 is present in an amount in the range of 10 to 15% by weight of said composition.

37. A compound as defined in any of Sentences 1 to 29, or 32 to 34, wherein the oligonucleoside comprises an RNA duplex which further comprises one or more riboses modified at the 2' position, preferably a plurality of riboses modified at the 2' position.

more degradation protective moieties is selected from phosphorothioate internucleoside linkages, phosphorodithioate internucleoside linkages and inverted abasic nucleosides, wherein said inverted abasic nucleosides are present at the distal end of the strand that carries the ligand moieties.

41. A compound according to any of Sentences 1 to 29, or 32 to 34, or 37 to 40, wherein said ligand moiety as depicted in Formula (I) in Sentence 1 comprises one or more ligands.

42. A compound according to Sentence 41, wherein said ligand moiety as depicted in Formula (I) in Sentence 1 comprises one or more carbohydrate ligands.

43. A compound according to Sentence 42, wherein said one or more carbohydrates can be a monosaccharide, disaccharide, trisaccharide, tetrasaccharide, oligosaccharide or polysaccharide.

44. A compound according to Sentence 43, wherein said one or more carbohydrates comprise one or more galactose moieties, one or more lactose moieties, one or more N-AcetylGalactosamine moieties, and/or one or more mannose moieties.

45. A compound according to Sentence 44, wherein said one or more carbohydrates comprise one or more N-Acetyl-Galactosamine moieties.

46. A compound according to Sentence 45, which comprises two or three N-AcetylGalactosamine moieties.

47. A compound according to any of Sentences 41 to 46, wherein said one or more ligands are attached in a linear configuration, or in a branched configuration.

48. A compound according to Sentence 47, wherein said one or more ligands are attached as a biantennary or triantennary branched configuration.

49. A compound according to Sentences 46 to 48, wherein said moiety:

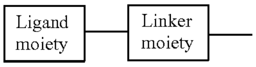

as depicted in Formula (I) in Sentence 1 is any of Formulae (VIa), (VIb) or (VIc), preferably Formula (VIa):

Formula (VIa)

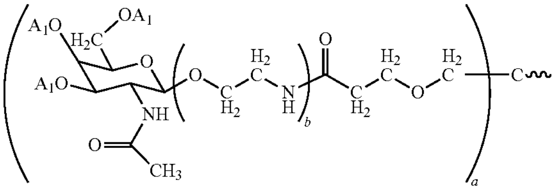

wherein:
$A_1$ is hydrogen, or a suitable hydroxy protecting group;
a is an integer of 2 or 3; and
b is an integer of 2 to 5; or Formula (VIb)

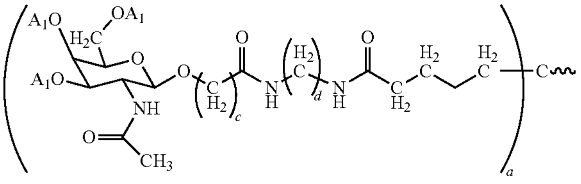

wherein:
$A_1$ is hydrogen, or a suitable hydroxy protecting group;
a is an integer of 2 or 3; and
c and d are independently integers of 1 to 6; or Formula (VIc)

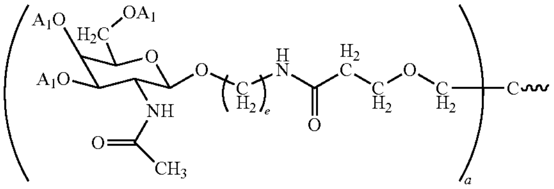

wherein:
$A_1$ is hydrogen, or a suitable hydroxy protecting group;
a is an integer of 2 or 3; and
e is an integer of 2 to 10.

50. A compound according to Sentences 46 to 48, wherein said moiety:

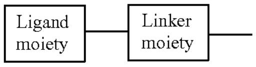

as depicted in Formula (I) in Sentence 1 is Formula (VII):

Formula (VII)

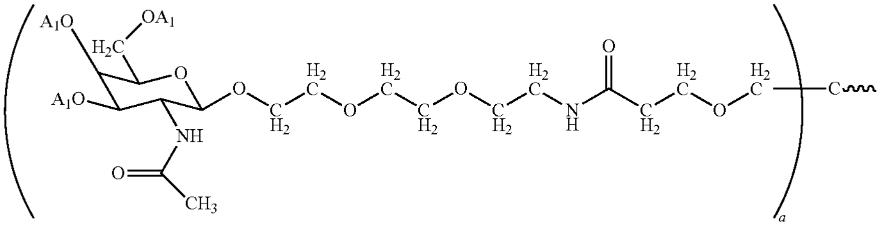

wherein:

$A_1$ is hydrogen;

a is an integer of 2 or 3.

51. A compound according to Sentence 49 or 50, wherein a=2.

52. A compound according to Sentence 49 or 50, wherein a=3.

53. A compound according to Sentence 49, wherein b=3.

54. A compound of Formula (VIII):

Formula (VIII)

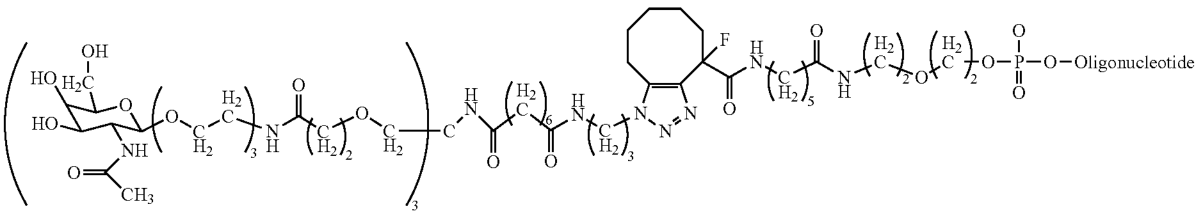

55. A compound of Formula (IX):

Formula (IX)

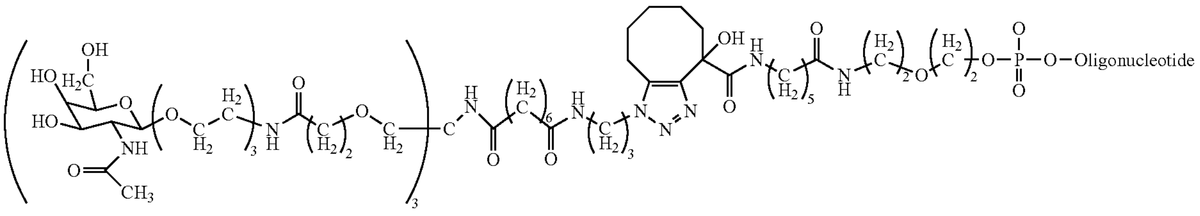

56. A compound according to Sentence 54 or 55, wherein the oligonucleoside comprises an RNA duplex comprising first and second strands, wherein the first strand is at least partially complementary to an RNA sequence of a target gene, and the second strand is at least partially complementary to said first strand, and wherein each of the first and second strands have 5' and 3' ends, and wherein said RNA duplex is attached at the 5' end of its second strand to the adjacent phosphate.

57. A composition comprising a compound of Formula (VIII) as defined in Sentence 54, and a compound of Formula (IX) as defined in Sentence 55, optionally dependent on Sentence 56.

58. A composition according to Sentence 57, wherein said compound of Formula (IX) as defined in Sentence 55 is present in an amount in the range of 10 to 15% by weight of said composition.

59. A compound of Formula (X):

Formula (X)

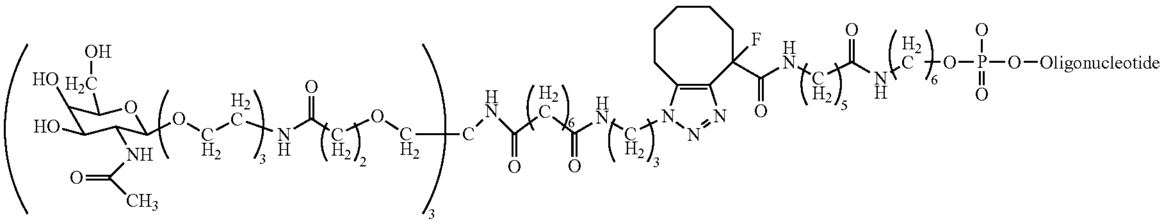

60. A compound of Formula (XI):

Formula (XI)

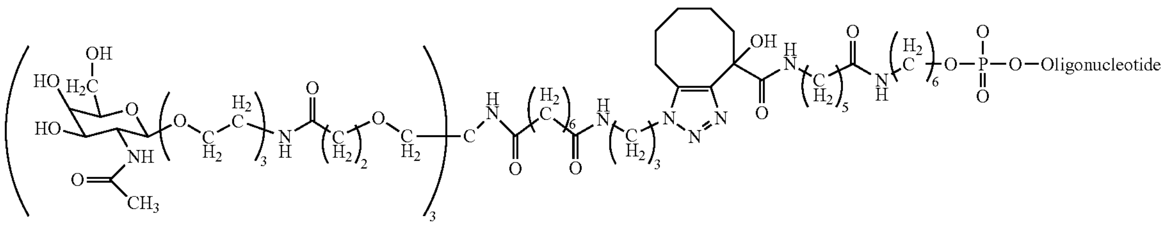

61. A compound according to Sentence 59 or 60, wherein the oligonucleoside comprises an RNA duplex comprising first and second strands, wherein the first strand is at least partially complementary to an RNA sequence of a target gene, and the second strand is at least partially complementary to said first strand, and wherein each of the first and second strands have 5' and 3' ends, and wherein said RNA duplex is attached at the 3' end of its second strand to the adjacent phosphate.

62. A composition comprising a compound of Formula (X) as defined in Sentence 59, and a compound of Formula (XI) as defined in Sentence 60, optionally dependent on Sentence 61.

63. A composition according to Sentence 62, wherein said compound of Formula (XI) as defined in Sentence 60 is present in an amount in the range of 10 to 15% by weight of said composition.

64. A compound as defined in any of Sentences 54 to 63, wherein the oligonucleoside comprises an RNA duplex which further comprises one or more riboses modified at the 2' position, preferably a plurality of riboses modified at the 2' position.

65. A compound according to Sentence 64, wherein the modifications are chosen from 2'-O-methyl, 2'-deoxy-fluoro, and 2'-deoxy.

66. A compound according to any of Sentences 54 to 65, wherein the oligonucleoside further comprises one or more degradation protective moieties at one or more ends.

67. A compound according to Sentence 66, wherein said one or more degradation protective moieties are not present at the end of the oligonucleoside strand that carries the ligand moieties, and/or wherein said one or more degradation protective moieties is selected from phosphorothioate internucleoside linkages, phosphorodithioate internucleoside linkages and inverted abasic nucleosides, wherein said inverted abasic nucleosides are present at the distal end of the strand that carries the ligand moieties, as shown in any of Formulae (VIII), (IX), (X) or (XI) in any of Sentences 54, 55, 59 or 60.

68. A process of preparing a compound according to any of Sentences 1 to 29, 32 to 34, 37 to 56, 59 to 61, and 64 to 67, and/or a composition according to any of Sentences 30, 31, 35, 36, 57, 58, 62, 63, which comprises reacting compounds of Formulae (XII) and (XIII):

Formula (XII)

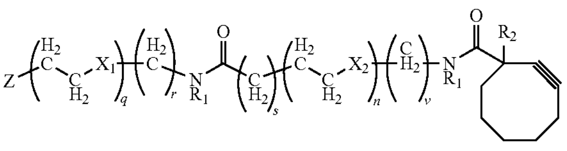

Formula (XIII)

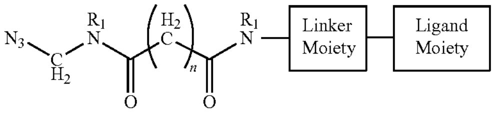

herein:

$R_1$ at each occurrence is independently selected from the group consisting of hydrogen, methyl and ethyl;

$R_2$ is selected from the group consisting of hydrogen, hydroxy, $-OC_{1-3}$alkyl, $-C(=O)OC_{1-3}$alkyl, halo and nitro;

$X_1$ and $X_2$ at each occurrence are independently selected from the group consisting of methylene, oxygen and sulfur;

m is an integer of from 1 to 6;

n is an integer of from 1 to 10;

q, r, s, t, v are independently integers from 0 to 4, with the proviso that:

(i) q and r cannot both be 0 at the same time; and (ii) s, t and v cannot all be 0 at the same time;

Z is an oligonucleoside moiety;

and where appropriate carrying out deprotection of the ligand and/or annealing of a second strand for the oligonucleoside moiety.

69. A process according to Sentence 68, wherein a compound of Formula (XII) is prepared by reacting compounds of Formulae (XIV) and (XV):

Formula (XIV)

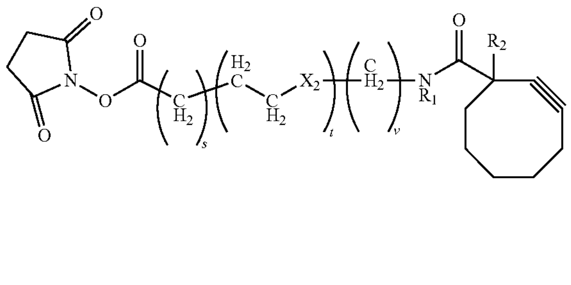

-continued

Formula (XV)

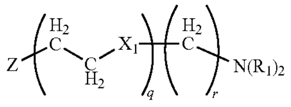

$R_1$ at each occurrence is independently selected from the group consisting of hydrogen, methyl and ethyl;

$R_2$ is selected from the group consisting of hydrogen, hydroxy, $-OC_{1-3}$alkyl, $-C(=O)OC_{1-3}$alkyl, halo and nitro;

$X_1$ and $X_2$ at each occurrence are independently selected from the group consisting of methylene, oxygen and sulfur;

q, r, s, t, v are independently integers from 0 to 4, with the proviso that:

(i) q and r cannot both be 0 at the same time; and (ii) s, t and v cannot all be 0 at the same time;

Z is an oligonucleoside moiety.

70. A process according to Sentence 68, to prepare a compound according to any of Sentences 20, 25, 27, 29, 54, 56, and/or a composition according to any of Sentences 30, 31, 57, 58, wherein:

compound of Formula (XII) is Formula (XIIa):

Formula (XIIa)

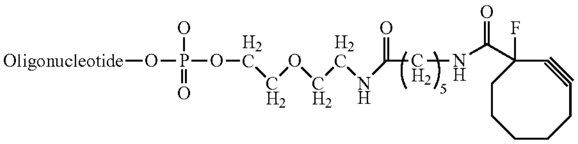

and compound of Formula (XIII) is Formula (XIIIa):

Formula (XIIIa)

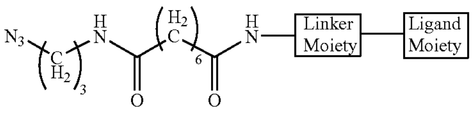

wherein the oligonucleoside comprises an RNA duplex comprising first and second strands, wherein the first strand is at least partially complementary to an RNA sequence of a target gene, and the second strand is at least partially complementary to said first strand, and wherein each of the first and second strands have 5' and 3' ends, and wherein said RNA duplex is attached at the 5' end of its second strand to the adjacent phosphate.

71. A process according to Sentence 68, to prepare a compound according to any of Sentences 20, 25, 28, 29, 55, 56, and/or a composition according to any of Sentences 30, 31, 57, 58, wherein:

compound of Formula (XII) is Formula (XIIb):

Formula (XIIb)

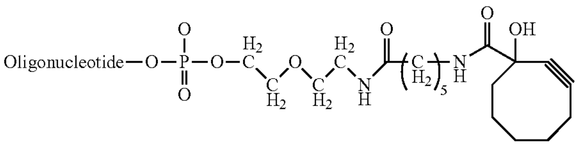

and compound of Formula (XIII) is Formula (XIIIa):

Formula (XIIIa)

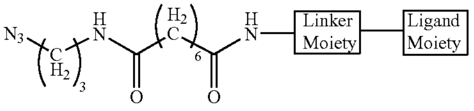

wherein the oligonucleoside comprises an RNA duplex comprising first and second strands, wherein the first strand is at least partially complementary to an RNA sequence of a target gene, and the second strand is at least partially complementary to said first strand, and wherein each of the first and second strands have 5' and 3' ends, and wherein said RNA duplex is attached at the 5' end of its second strand to the adjacent phosphate.

72. A process according to Sentence 68, to prepare a compound according to any of Sentences 21, 26, 32, 34, 59, 61, and/or a composition according to any of Sentences 35, 36, 62, 63, wherein:

compound of Formula (XII) is Formula (XIIc):

Formula (XIIc)

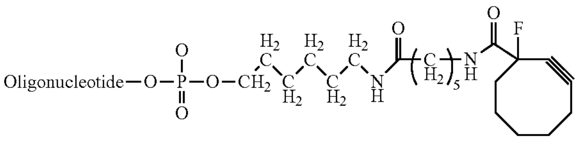

and compound of Formula (XIII) is Formula (XIIIa):

Formula (XIIIa)

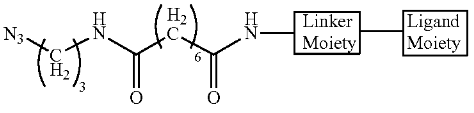

wherein the oligonucleoside comprises an RNA duplex comprising first and second strands, wherein the first strand is at least partially complementary to an RNA sequence of a target gene, and the second strand is at least partially complementary to said first strand, and wherein each of the first and second strands have 5' and 3' ends, and wherein said RNA duplex is attached at the 3' end of its second strand to the adjacent phosphate.

73. A process according to Sentence 68, to prepare a compound according to any of Sentences 21, 26, 33, 34, 60, 61, and/or a composition according to any of Sentences 35, 36, 62, 63, wherein:

compound of Formula (XII) is Formula (XIId):

Formula (XIId)

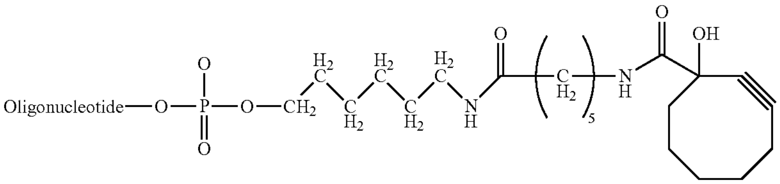

and compound of Formula (XIII) is Formula (XIIIa):

Formula (XIIIa)

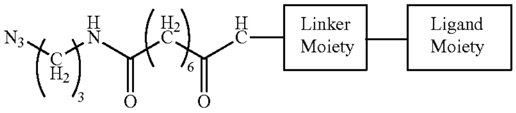

wherein the oligonucleoside comprises an RNA duplex comprising first and second strands, wherein the first strand is at least partially complementary to an RNA sequence of a target gene, and the second strand is at least partially complementary to said first strand, and wherein each of the first and second strands have 5' and 3' ends, and wherein said RNA duplex is attached at the 3' end of its second strand to the adjacent phosphate.

74. A process according to any of Sentences 70 to 73, wherein:

compound of Formula (XIIIa) is Formula (XIIIb):

Formula (XIIIb)

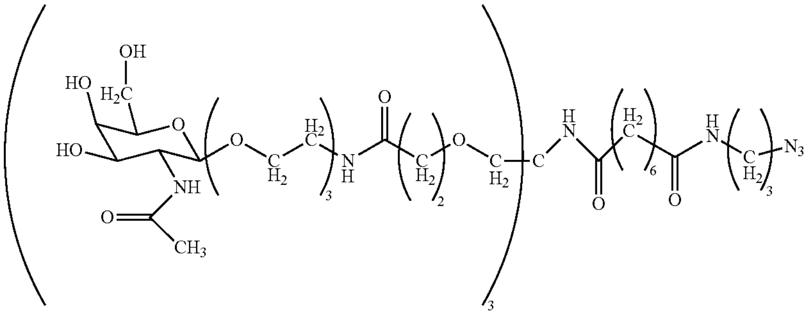

75. A process according to Sentences 69, as dependent on Sentences 70 to 73, wherein: compound of Formula (XIV) is either Formula (XIVa) or Formula (XIVb):

Formula (XIVa)

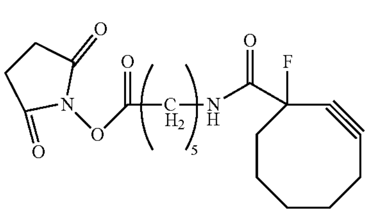

-continued

Formula (XIVb)

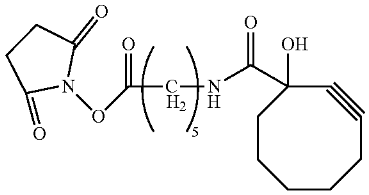

and compound of Formula (XV) is either Formula (XVa) or Formula (XIVb):

Formula (XVa)

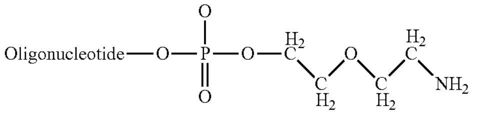

Formula (XVb)

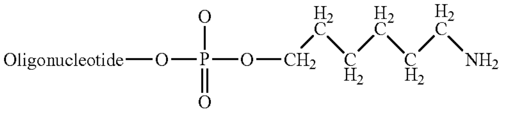

wherein the oligonucleoside comprises an RNA duplex comprising first and second strands, wherein the first strand is at least partially complementary to an RNA sequence of a target gene, and the second strand is at least partially complementary to said first strand, and wherein each of the first and second strands have 5' and 3' ends, and wherein (i) said RNA duplex is attached at the 5' end of its second strand to the adjacent phosphate in Formula (XVa), or (ii) said RNA duplex is attached at the 3' end of its second strand to the adjacent phosphate in Formula (XVb).

76. A compound of Formula (XII):

Formula (XII)

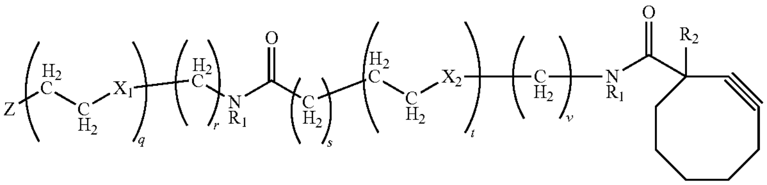

wherein:

$R_1$ at each occurrence is independently selected from the group consisting of hydrogen, methyl and ethyl;

$R_2$ is selected from the group consisting of hydrogen, hydroxy, —$OC_{1-3}$alkyl, —C(═O)$OC_{1-3}$alkyl, halo and nitro;

$X_1$ and $X_2$ at each occurrence are independently selected from the group consisting of methylene, oxygen and sulfur;

q, r, s, t, v are independently integers from 0 to 4, with the proviso that:

(i) q and r cannot both be 0 at the same time; and (ii) s, t and v cannot all be 0 at the same time;

Z is an oligonucleoside moiety.

77. A compound of Formula (XIIa):

Formula (XIIa)

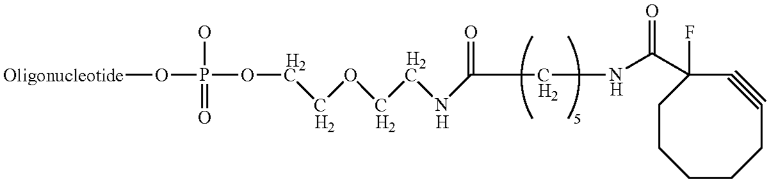

78. A compound of Formula (XIIb):

Formula (XIIb)

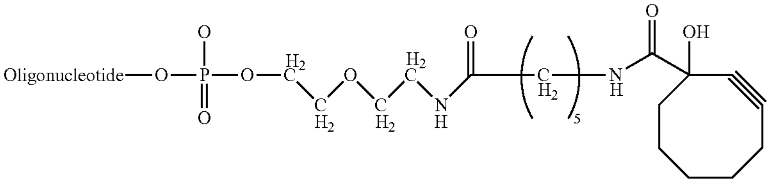

79. A compound of Formula (XIIc):

Formula (XIIc)

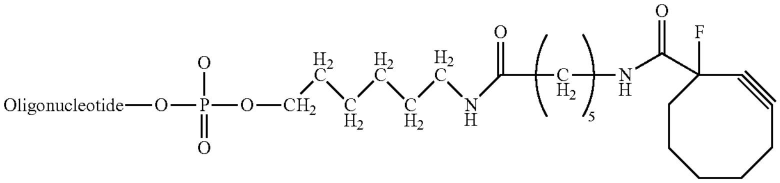

80. A compound of Formula (XIId):

Formula (XIId)

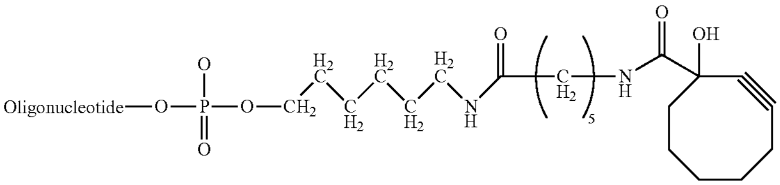

81. A compound of Formula (XIII):

Formula (XIII)

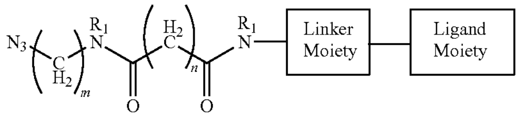

wherein:

$R_1$ at each occurrence is independently selected from the group consisting of hydrogen, methyl and ethyl;

m is an integer of from 1 to 6;

n is an integer of from 1 to 10.

82. A compound of Formula (XIIIa):

Formula (XIIIa)

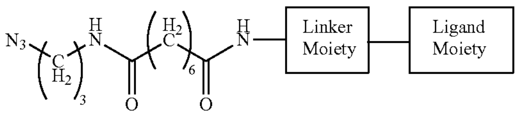

83. A compound of Formula (XIIIb):

Formula (XIIIb)

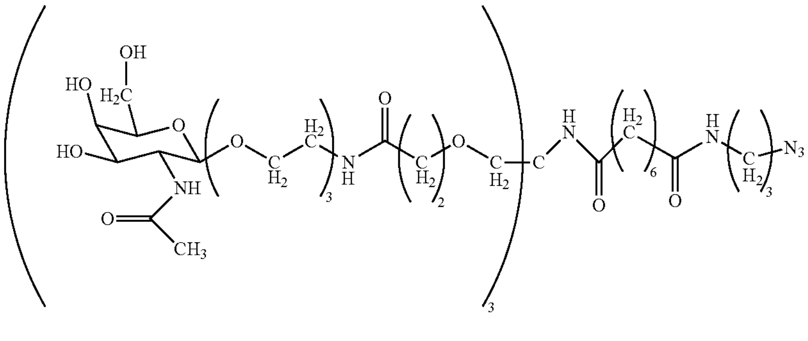

84. A compound of Formula (XIV):

Formula (XIV)

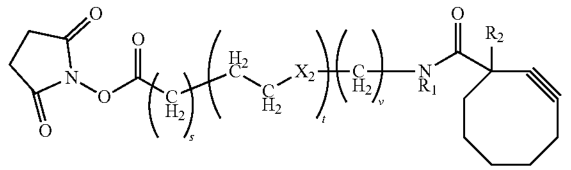

wherein:

$R_1$ is selected from the group consisting of hydrogen, methyl and ethyl;

$R_2$ is selected from the group consisting of hydrogen, hydroxy, —$OC_{1-3}$alkyl, —C(═O)$OC_{1-3}$alkyl, halo and nitro;

$X_2$ is selected from the group consisting of methylene, oxygen and sulfur;

s, t, v are independently integers from 0 to 4, with the proviso that s, t and v cannot all be 0 at the same time.

85. A compound of Formula (XIVa):

Formula (XIVa)

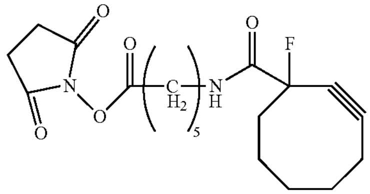

86. A compound of Formula (XIVb):

Formula (XIVb)

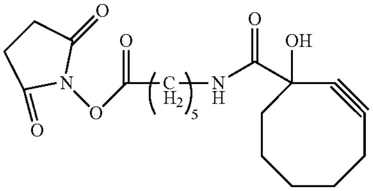

87. A compound of Formula (XV):

Formula (XV)

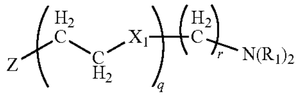

wherein:

$R_1$ at each occurrence is independently selected from the group consisting of hydrogen, methyl and ethyl;

$X_1$ is selected from the group consisting of methylene, oxygen and sulfur;

q and r are independently integers from 0 to 4, with the proviso that q and r cannot both be 0 at the same time;

Z is an oligonucleoside moiety.

88. A compound of Formula (XVa):

Formula (XVa)

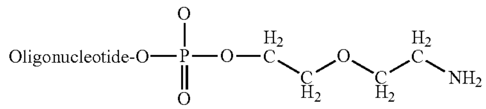

89. A compound of Formula (XVb):

Formula (XVb)

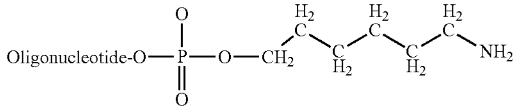

90. Use of a compound according to any of Sentences 76, 81 to 84, 87, for the preparation of a compound according to any of Sentences 1 to 29, 32 to 34, 37 to 56, 59 to 61, and 64 to 67, and/or a composition according to any of Sentences 30, 31, 35, 36, 57, 58, 62 and 63.

91. Use of a compound according to Sentence 85, for the preparation of a compound according to any of Sentences 1 to 29, 32 to 34, 37 to 56, 59 to 61, and 64 to 67, and/or a composition according to any of Sentences 30, 31, 35, 36, 57, 58, 62 and 63, wherein $R_2$=F.

92. Use of a compound according to Sentence 86, for the preparation of a compound according to any of Sentences 1 to 29, 32 to 34, 37 to 56, 59 to 61, and 64 to 67, and/or a composition according to any of Sentences 30, 31, 35, 36, 57, 58, 62 and 63, wherein $R_2$=OH.

93. Use of a compound according to Sentence 77, for the preparation of a compound according to any of Sentences 20, 25, 27, 29, 54, 56, and/or a composition according to any of Sentences 30, 31, 57, 58.

94. Use of a compound according to Sentence 78, for the preparation of a compound according to any of Sentences 20, 25, 28, 29, 55, 56, and/or a composition according to any of Sentences 30, 31, 57, 58.

95. Use of a compound according to Sentence 79, for the preparation of a compound according to any of Sentences 21, 26, 32, 34, 59, 61, and/or a composition according to any of Sentences 35, 36, 62, 63.

96. Use of a compound according to Sentence 80, for the preparation of a compound according to any of Sentences 21, 26, 33, 34, 60, 61, and/or a composition according to any of Sentences 35, 36, 62, 63.

97. Use of a compound according to Sentence 88, for the preparation of a compound according to any of Sentences 20, 25, 27 to 29, 54 to 56, and/or a composition according to any of Sentences 30, 31, 57, 58.

98. Use of a compound according to Sentence 89, for the preparation of a compound according to any of Sentences 21, 26, 32 to 34, 59 to 61, and/or a composition according to any of Sentences 35, 36, 62, 63.

99. A compound or composition obtained, or obtainable by a process according to any of Sentences 68 to 75.

100. A pharmaceutical composition comprising of a compound according to any of Sentences 1 to 29, 32 to 34, 37 to 56, 59 to 61, and 64 to 67, and/or a composition according to any of Sentences 30, 31, 35, 36, 57, 58, 62 and 63, together with a pharmaceutically acceptable carrier, diluent or excipient.

101. A compound according to any of Sentences 1 to 29, 32 to 34, 37 to 56, 59 to 61, and 64 to 67, and/or a composition according to any of Sentences 30, 31, 35, 36, 57, 58, 62 and 63, for use in therapy.

In another aspect the present invention may be applied in the compounds, processes, compositions or uses of the following Clauses numbered 1-56 (wherein reference to any Formula in the Clauses refers only to those Formulas that are defined within Clause 1-56. These formulae are reproduced in FIG. 7).

1. A compound comprising the following structure:

Formula (I*)

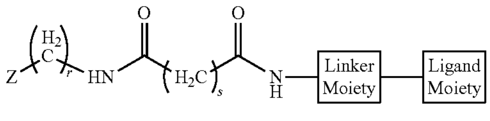

wherein:

r and s are independently an integer selected from 1 to 16; and

Z is an oligonucleoside moiety.

2. A compound according to Clause 1, wherein s is an integer selected from 4 to 12.
3. A compound according to Clause 2, wherein s is 6.
4. A compound according to any of Clauses 1 to 3, wherein r is an integer selected from 4 to 14.
5. A compound according to Clause 4, wherein r is 6.
6. A compound according to Clause 4, wherein r is 12.
7. A compound according to Clause 5, which is dependent on Clause 3.
8. A compound according to Clause 6, which is dependent on Clause 3.

9. A compound according to any of Clauses 1 to 8, wherein Z is:

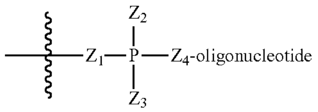

wherein:

$Z_1$, $Z_2$, $Z_3$, $Z_4$ are independently at each occurrence oxygen or sulfur; and one the bonds between P and $Z_2$, and P and $Z_3$ is a single bond and the other bond is a double bond.

10. A compound according to any of Clauses 1 to 9, wherein said oligonucleoside is an RNA compound capable of modulating, preferably inhibiting, expression of a target gene.
11. A compound according to any of Clause 10, wherein said RNA compound comprises an RNA duplex comprising first and second strands, wherein the first strand is at least partially complementary to an RNA sequence of a target gene, and the second strand is at least partially complementary to said first strand, and wherein each of the first and second strands have 5' and 3' ends.
12. A compound according to Clause 11, preferably also dependent on Clauses 3 and 6, wherein the RNA compound is attached at the 5' end of its second strand to the adjacent phosphate.
13. A compound according to Clause 11, preferably also dependent on Clauses 3 and 5, wherein the RNA compound is attached at the 3' end of its second strand to the adjacent phosphate.
14. A compound of Formula (II*), preferably dependent on Clause 12:

Formula (II*)

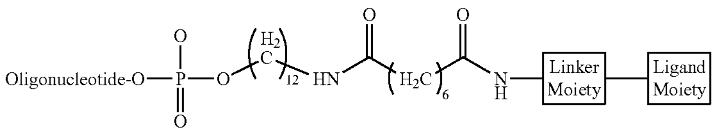

15. A compound of Formula (III*), preferably dependent on Clause 13:

Formula (III*)

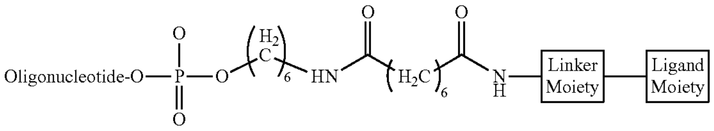

16. A compound as defined in any of Clauses 1 to 15, wherein the oligonucleoside comprises an RNA duplex which further comprises one or more riboses modified at the 2' position, preferably a plurality of riboses modified at the 2' position.

17. A compound according to Clause 16, wherein the modifications are chosen from 2'-O-methyl, 2'-deoxy-fluoro, and 2'-deoxy.

18. A compound according to any of Clauses 1 to 17, wherein the oligonucleoside further comprises one or more degradation protective moieties at one or more ends.

19. A compound according to Clause 18, wherein said one or more degradation protective moieties are not present at the end of the oligonucleoside strand that carries the linker/ligand moieties, and/or wherein said one or more degradation protective moieties is selected from phosphorothioate internucleoside linkages, phosphorodithioate internucleoside linkages and inverted abasic nucleosides, wherein said inverted abasic nucleosides are present at the distal end of the same strand to the end that carries the linker/ligand moieties.

20. A compound according to any of Clauses 1 to 19, wherein said ligand moiety as depicted in Formula (I*) in Clause 1 comprises one or more ligands.

21. A compound according to Clause 20, wherein said ligand moiety as depicted in Formula (I*) in Clause 1 comprises one or more carbohydrate ligands.

22. A compound according to Clause 21, wherein said one or more carbohydrates can be a monosaccharide, disaccharide, trisaccharide, tetrasaccharide, oligosaccharide or polysaccharide.

23. A compound according to Clause 22, wherein said one or more carbohydrates comprise one or more galactose moieties, one or more lactose moieties, one or more N-AcetylGalactosamine moieties, and/or one or more mannose moieties.

24. A compound according to Clause 23, wherein said one or more carbohydrates comprise one or more N-Acetyl-Galactosamine moieties.

25. A compound according to Clause 24, which comprises two or three N-AcetylGalactosamine moieties.

26. A compound according to any of the preceding Clauses, wherein said one or more ligands are attached in a linear configuration, or in a branched configuration.

27. A compound according to Clause 26, wherein said one or more ligands are attached as a biantennary or triantennary branched configuration.

28. A compound according to Clauses 20 to 27, wherein said moiety:

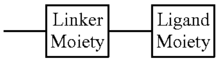

as depicted in Formula (I*) in Clause 1 is any of Formulae (IV*), (V*) or (VI*), preferably Formula (IV*):

Formula (IV*)

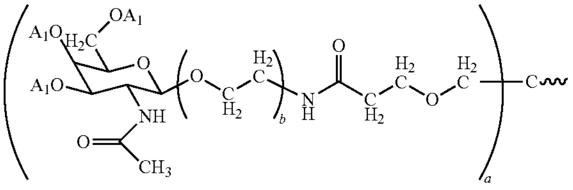

wherein:

$A_1$ is hydrogen, or a suitable hydroxy protecting group;

a is an integer of 2 or 3; and b is an integer of 2 to 5; or

Formula (V*)

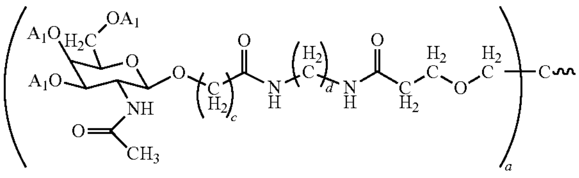

wherein:

$A_1$ is hydrogen, or a suitable hydroxy protecting group;

a is an integer of 2 or 3; and c and d are independently integers of 1 to 6; or

Formula (VI*)

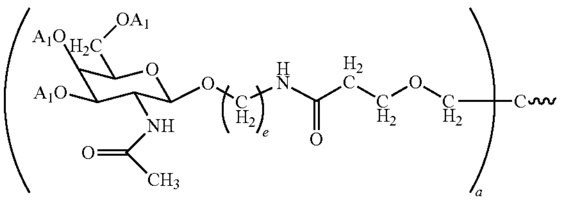

wherein:

$A_1$ is hydrogen, or a suitable hydroxy protecting group;

a is an integer of 2 or 3; and e is an integer of 2 to 10.

29. A compound according to any of Clauses 1 to 28, wherein said moiety:

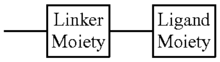

as depicted in Formula (I*) in Clause 1 is Formula (VII*):

Formula (VII*)

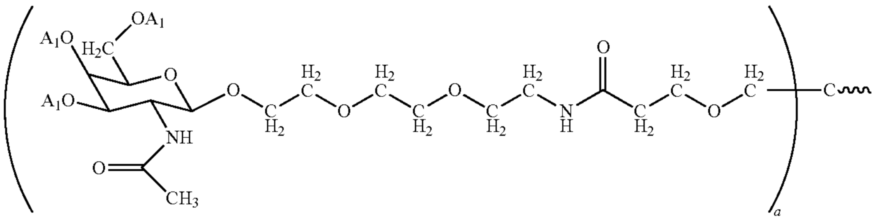

wherein:

$A_1$ is hydrogen;

a is an integer of 2 or 3.

30. A compound according to Clause 28 or 29, wherein a=2.
31. A compound according to Clause 28 or 29, wherein a=3.
32. A compound according to Clause 28, wherein b=3.
33. A compound of Formula (VIII*):

Formula (VIII*)

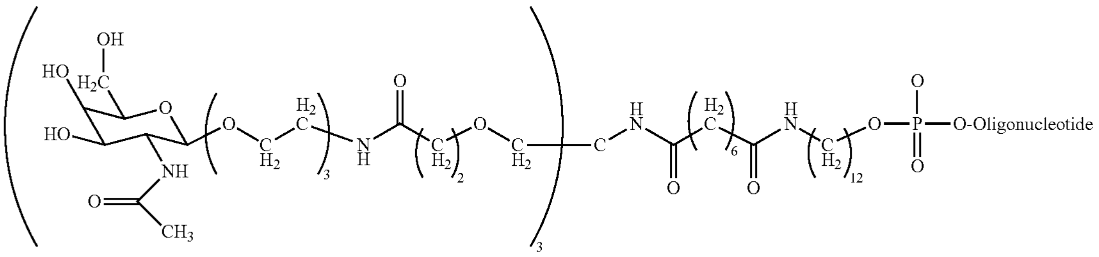

34. A compound of Formula (IX*):

Formula (IX*)

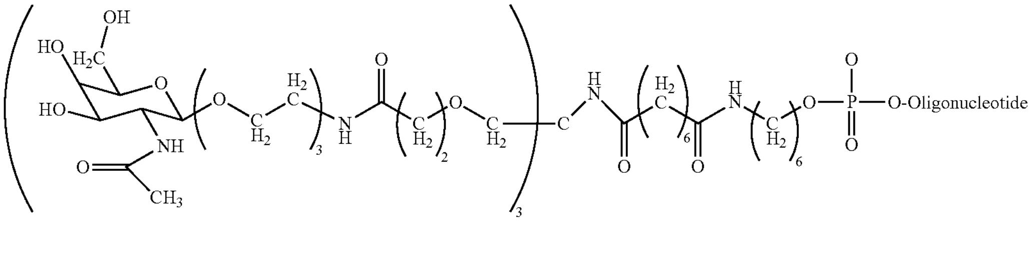

35. A compound according to Clause 33 or 34, wherein the oligonucleoside comprises an RNA duplex which further comprises one or more riboses modified at the 2' position, preferably a plurality of riboses modified at the 2' position.
36. A compound according to Clause 35, wherein the modifications are chosen from 2'-O-methyl, 2'-deoxy-fluoro, and 2'-deoxy.
37. A compound according to any of Clauses 33 to 36, wherein the oligonucleoside further comprises one or more degradation protective moieties at one or more ends.
38. A compound according to Clause 37, wherein said one or more degradation protective moieties are not present at the end of the oligonucleoside strand that carries the linker/ligand moieties, and/or wherein said one or more degradation protective moieties is selected from phosphorothioate internucleoside linkages, phosphorodithioate internucleoside linkages and inverted abasic nucleosides, wherein said inverted abasic nucleosides are present at the distal end of the same strand to the end that carries the linker/ligand moieties.
39. A compound according to Clause 33, wherein the oligonucleoside comprises an RNA duplex comprising first and second strands, wherein the first strand is at least partially complementary to an RNA sequence of a target gene, and the second strand is at least partially complementary to said first strand, and wherein each of the first and second strands have 5' and 3' ends, and wherein said RNA duplex is attached at the 5' end of its second strand to the adjacent phosphate.
40. A compound according to Clause 34, wherein the oligonucleoside comprises an RNA duplex comprising first and second strands, wherein the first strand is at least partially complementary to an RNA sequence of a target gene, and the second strand is at least partially complementary to said first strand, and wherein each of the first and second strands have 5' and 3' ends, and wherein said RNA duplex is attached at the 3' end of its second strand to the adjacent phosphate.

41. A process of preparing a compound according to any of Clauses 1 to 40, which comprises reacting compounds of Formulae (X*) and (XI*):

Formula (X*)

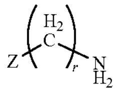

Formula (XI*)

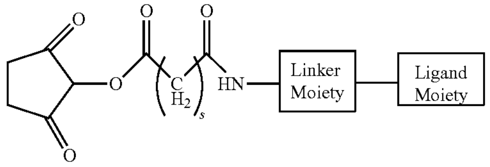

wherein:

r and s are independently an integer selected from 1 to 16; and

Z is an oligonucleoside moiety;

and where appropriate carrying out deprotection of the ligand and/or annealing of a second strand for the oligonucleoside.

42. A process according to Clause 41, to prepare a compound according to any of Clauses 6, 8 to 14, 16 to 33, and 35 to 40, wherein:

compound of Formula (X*) is Formula (Xa*):

Formula (Xa*)

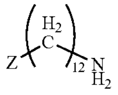

and compound of Formula (XI*) is Formula (XIa*):

Formula (XIa*)

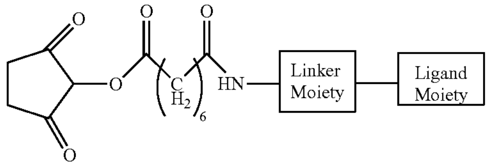

wherein the oligonucleoside comprises an RNA duplex comprising first and second strands, wherein the first strand is at least partially complementary to an RNA sequence of a target gene, and the second strand is at least partially complementary to said first strand, and wherein each of the first and second strands have 5' and 3' ends, and wherein said RNA duplex is attached at the 5' end of its second strand to the adjacent phosphate.

43. A process according to Clause 41, to prepare a compound according to any of Clauses 5, 7, 9 to 13, 15 to 32, and 34 to 40, wherein:

compound of Formula (X*) is Formula (Xb*):

Formula (Xb*)

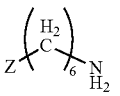

and compound of Formula (XI*) is Formula (XIa*):

Formula (XIa*)

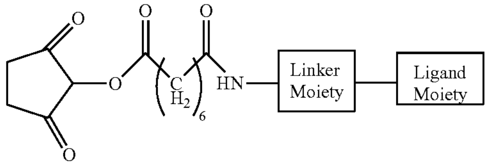

wherein the oligonucleoside comprises an RNA duplex comprising first and second strands, wherein the first strand is at least partially complementary to an RNA sequence of a target gene, and the second strand is at least partially complementary to said first strand, and wherein each of the first and second strands have 5' and 3' ends, and wherein said RNA duplex is attached at the 3' end of its second strand to the adjacent phosphate.

44. A process according to Clauses 42 or 43, wherein:

compound of Formula (XIa*) is Formula (XIb*):

Formula (XIb*)

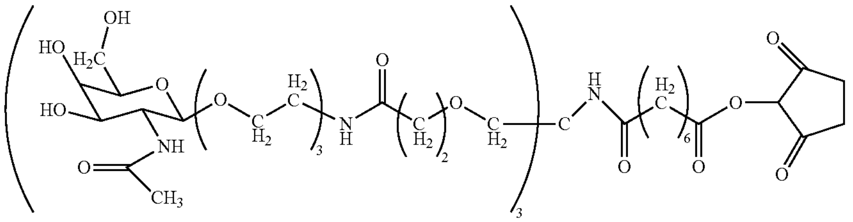

45. A compound of Formula (X*):

Formula (X*)

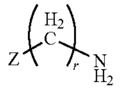

wherein:
r is independently an integer selected from 1 to 16; and
Z is an oligonucleoside moiety.

46. A compound of Formula (Xa*):

Formula (Xa*)

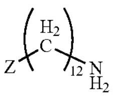

47. A compound of Formula (Xb*):

Formula (Xb*)

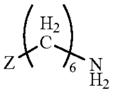

48. A compound of Formula (XI*):

Formula (XI*)

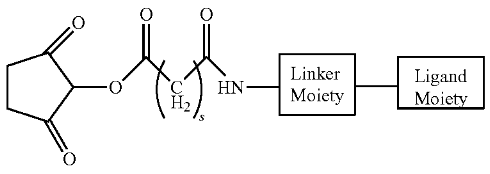

wherein:
s is independently an integer selected from 1 to 16; and
Z is an oligonucleoside moiety.

49. A compound of Formula (XIa*):

Formula (XIa*)

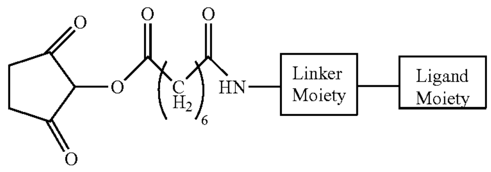

50. A compound of Formula (XIb*):

Formula (XIb*)

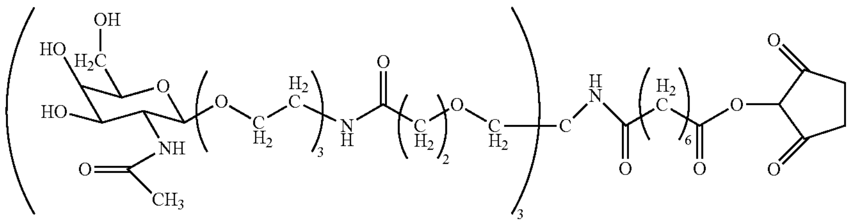

51. Use of a compound according to any of Clauses 45 and 48 to 50, for the preparation of a compound according to any of Clauses 1 to 40.

52. Use of a compound according to Clause 46, for the preparation of a compound according to any of Clauses 6, 8 to 14, 16 to 33, and 35 to 40.

53. Use of a compound according to Clause 47, for the preparation of a compound according to any of Clauses 5, 7, 9 to 13, 15 to 32, and 34 to 40.

54. A compound or composition obtained, or obtainable by a process according to any of Clauses 41 to 44.

55. A pharmaceutical composition comprising of a compound according to any of Clauses 1 to 40, together with a pharmaceutically acceptable carrier, diluent or excipient.

56. A compound according to any of Clauses 1 to 40, for use in therapy.

EXAMPLES

The invention will be more fully understood by reference to the following examples. They should not, however, be construed as limiting the scope of the invention. It is understood that the examples and embodiments described herein are for illustrative purposes only and that various modifications or changes in light thereof will be suggested to persons skilled in the art and are to be included within the spirit and purview of this application and scope of the appended claims.

Example 1—Target Identification

Background

Genome-wide association (GWAS) studies aim to discover statistical associations between inherited variations in chromosomal DNA (genotypes) and the physical or functional characteristics of individuals (phenotypes). There are several kinds of genetic variability of which the most commonly studied in GWAS are single nucleotide polymorphisms (SNPs) where individual nucleotides in the background DNA sequence of the genome may vary between individuals. These SNPs can result in changes in gene or protein function. This can occur either directly (in the coding regions of genes) or indirectly (through effects on gene regulation). The mapping between SNPs and genes is not always 1:1 but can be many to one or one to many. GWAS studies have been used in drug discovery to identify genes whose variation is correlated (either positively or negatively) with the risk of developing particular diseases such as type 2 diabetes, or atherosclerosis; or with particular outcomes consequent on those diseases e.g. stroke or myocardial infarction. Occasionally, where most of the risk is concentrated in a single variant, or where multiple variants map to a single gene, the identification of such a gene can yield a clinically useful drug target. But this is the exception rather than the rule.

In complex (multifactorial) diseases such as diabetes a more typical outcome of a GWAS analysis is a long list of genes estimated to be correlated with the disease under investigation but where each gene carries only a very small portion of the risk. How to use these long lists of weakly associated genes to elucidate biological mechanisms and drive drug target discovery is the core problem being addressed. In addition, there is typically considerable uncertainty around the mapping of the underlying weakly correlated SNPs to their associated gene or genes; and of the relationship between genes such that the underlying biology is consequently opaque. In such situations the identification of clinically viable drug targets is extremely challenging and usually fails.

The inventors have developed a proprietary computational approach to analysing such 'noisy' GWAS (and other 'omic) gene lists (that may contain hundreds of weakly correlated genes and many mapping errors) using network analysis approaches to identify the underlying biology driving complex disease risk and find drug targets that are otherwise undiscoverable by conventional methods.

To achieve this, the inventors employ proprietary network analysis approaches that allow them to allocate multiple genes to a smaller number of driver processes; and to mine these processes for impactful drug targets.

As stated above, the approach takes advantage of information that is usually ignored in standard analyses—the known and predicted (using proprietary methods) interactions between genes (and proteins) and the prediction of 'hidden players'—other genes with which the GWAS (or other 'omics) gene sets also interact.

Process for Identifying Processes and Targets

The first step is to hypothesise that the dysfunction that is correlated with 'disease' should not be viewed at the level of individual genes. Rather, each gene belongs to a set whose members collaborate in a co-ordinated network module of interacting proteins. The network gives rise to a biological process and it is dysfunction at the level of this process or network module that should be considered to be the driver of risk.

Each protein in the network that is impacted by the SNPs contributes a small component to the overall functional dysregulation of the network module that controls the biological process. And network modules can interact to produce dysfunction at even coarser levels of organisation.

For that, protein coding genes from a gene list were selected after fine mapping. Using an internally curated database of all possible protein-protein interactions (derived from external experimentation) and internal 'network construction' algorithms—a range of feasible networks were generated that include the maximum number of proteins from the list with the minimal number of imputed additional 'hidden player' proteins. The algorithms seek to find optimal ways to connect the protein coding genes, using paths that are constrained by the protein-protein interaction (PPI) data and imputing missing proteins according to a 'cost function'.

This process captures the relationships between protein-coding genes in the GWAS list and adds other proteins calculated to be involved in the same process ('Hidden Players').

In this way multiple small effects are integrated across a network or networks to generate larger effects.

The second step is to hypothesise that the pattern of connectivity within such networks is critical in determining the impact of gene dysfunction. This information is typically not easily available and is usually ignored in conventional analyses.

The networks obtained in the first step were used and a functional enrichment analysis was carried out. The functional enrichment analysis differs from the conventional approach because it incorporates information about imputed hidden players and the connectivity pattern of the proteins in addition to overlap. That is, the relationships between protein-coding genes in the GWAS list and 'Hidden Players' were used to identify pathways critical for the structure of the network.

For that, an internally curated pathway database was used that defines protein sets associated with a particular biological process. These proteins sets were then tested against the networks by measuring the 'structural impact' that removal of common proteins would have on the network and assigning an 'impact value' that is dependent on the specific wiring pattern of the network. Further statistical controls were performed to ensure that any bias in the statistical properties of the proteins in the GWAS set were controlled for.

The third step is to hypothesise that the gene list associated with a dysregulated function is incomplete due to the compounded errors and uncertainties outlined above; and additionally because variations in some key proteins may not be tolerated due to their potential severity. It is therefore necessary to 'impute' what is missing.

In a next step, pathways that are 'network enriched' by the above analysis were plotted in a 2 dimensional space where each pathway is represented by a point and the proximity of the points is a measure of the similarity of the pathways (see FIG. 8). The pathway data were enhanced by a technique that uses a search algorithm and the PPI database above to add additional members that are 'nearby in network space' according to another cost function. This allowed pathways that may not share many proteins but which share 'neighbours' to be compared. Similar pathways were aggregated into clusters using an unsupervised machine learning approach. The biological function of such clusters (the processes associated with risk) were determined by expert interpretation of the pathway annotations and protein annotations.

In a further step, directed network models were reconstructed from selected clusters of pathway protein sets representing biological processes associated with disease risk using an internal proprietary database of protein-protein relationships that includes 'direction' of interaction. This directional information was derived from a range of public and internal databases supplemented by imputed direction from natural language processing of text from scientific publications. Network construction algorithms using these sources of information were used to build 'directed' models of the key biological processes.

Proprietary analytical techniques were then applied to the network models to identify pharmacologically viable targets from within the networks whose knockdown will have a significant influence on the network and by extension on the biological function being modeled. The algorithms make extensive use of directional information and hierarchical relationships to identify targets with a range of specific properties that will make them good siRNA targets. Targets were then further filtered by protein class and hepatocyte specificity according to requirements.

Identification of Key Processes and siRNA Drug Targets in Type 2 Diabetes

The inventors have used a network biology approach to create network models of Type 2 diabetes. The network models are designed to capture all of the important proteins involved in the process as well as their connections and, importantly, the direction of information flow between pairs of proteins.

The inventors have analysed these network models using proprietary analytical methods. These methods use the directional information to capture key 'target' properties such as whether a protein is an integrator of information, a key conduit of information to other parts of the network, an influencer of key proteins and the extent to which an influencer is influenced or influences other proteins (based on absolute and relative number and direction of inputs and outputs). The directional information also enables hierarchical relationships between proteins to be imputed. Proteins higher in the hierarchy and with certain properties may be preferred over others with otherwise similar properties. The relative specificity and magnitude of each property relative to the others made it possible for the inventors to score and rank proteins in terms of their target suitability.

The ability to characterise the properties of these targets in terms of network relationships enables judgements to be made on the selectivity and magnitude of effect in the chosen context and hence the suitability of each for a given indication.

This enabled the inventors to identify targets that will provide improved treatment of Type 2 diabetes. The analyses used for this purpose are specifically tailored to find novel and non-obvious targets whose knockdown by GalNAc-siRNA in hepatocytes will be beneficial in the treatment of diabetes. For that, the inventors leveraged a large GWAS meta-analysis of 898,930 individuals of which 9% were diabetic (Mahajan et al., Nature Genetics, 2018, 50, p 1505-1513).

From that GWAS-meta-analysis, the inventors took a list of 257 genes derived from 403 distinct association signals that were weakly correlated with risk of developing type 2 diabetes. The 257 genes were subdivided amongst the categories in FIG. 9.

Using the proprietary network analysis approach described above, the inventors were able to identify a specific biological process: 'post-translational modification by glycosylation' which was significantly associated with type 2 diabetes risk in both normal and obese individuals. This process was not identifiable by standard 'functional enrichment' approaches and was not identified by the authors of the meta-analysis (Mahajan et al., Nature Genetics, 2018, 50, p 1505-1513).

The inventors were also able to demonstrate recovery of known diabetic risk associated processes using their network aware technique and to demonstrate the increased sensitivity of this approach—see FIG. 10.

Using a number of proprietary approaches, the inventors reconstructed a network model of this process and using their analytics ranked individual hepatocyte genes according to their predicted pharmacological impact and amenability to GalNAc-mediated siRNA knockdown to identify key target genes.

This approach has enabled the inventors to identify 3 hepatocyte expressed genes coding for secreted enzyme products, of which B4GALT1 is the most highly ranked hepatocyte-expressed target in the analysis. While a number of proteins ranked in the upper quartile, only 3 also passed the selection criteria of hepatocyte expression, secretion and being an enzyme (FIG. 11).

Example 2: Synthesis of Tether 1

General Experimental Conditions:

Thin layer chromatography (TLC) was performed on silica-coated aluminium plates with fluorescence indicator 254 nm from Macherey-Nagel. Compounds were visualized under UV light (254 nm), or after spraying with the 5% $H_2SO_4$ in methanol (MeOH) or ninhydrin reagent according to Stahl (from Sigma-Aldrich), followed by heating. Flash chromatography was performed with a Biotage Isolera One flash chromatography instrument equipped with a dual variable UV wavelength detector (200-400 nm) using Biotage Sfar Silica 10, 25, 50 or 100 g columns (Uppsala, Sweden).

All moisture-sensitive reactions were carried out under anhydrous conditions using dry glassware, anhydrous solvents, and argon atmosphere. All commercially available reagents were purchased from Sigma-Aldrich and solvents from Carl Roth GmbH+Co. KG. D-Galactosamine pentaacetate was purchased from AK scientific.

HPLC/ESI-MS was performed on a Dionex UltiMate 3000 RS UHPLC system and Thermo Scientific MSQ Plus Mass spectrometer using an Acquity UPLC Protein BEH C4 column from Waters (300 Å, 1.7 μm, 2.1×100 mm) at 60° C. The solvent system consisted of solvent A with $H_2O$ containing 0.1% formic acid and solvent B with acetonitrile (ACN) containing 0.1% formic acid. A gradient from 5-100% of B over 15 min with a flow rate of 0.4 mL/min was employed. Detector and conditions: Corona ultra-charged aerosol detection (from esa). Nebulizer Temp.: 25° C. $N_2$ pressure: 35.1 psi. Filter: Corona.

$^1H$ and $^{13}C$ NMR spectra were recorded at room temperature on a Varian spectrometer at 500 MHz ($^1H$ NMR) and 125 MHz ($^{13}C$ NMR). Chemical shifts are given in ppm referenced to the solvent residual peak ($CDCl_3$—$^1H$ NMR: 8 at 7.26 ppm and $^{13}C$ NMR 6 at 77.2 ppm; DMSO-$d_6$—1H NMR: S at 2.50 ppm and $^{13}C$ NMR 6 at 39.5 ppm). Coupling constants are given in Hertz. Signal splitting patterns are described as singlet (s), doublet (d), triplet (t) or multiplet (m).

Synthesis route for the conjugate building block TriGalNAc_Tether1:

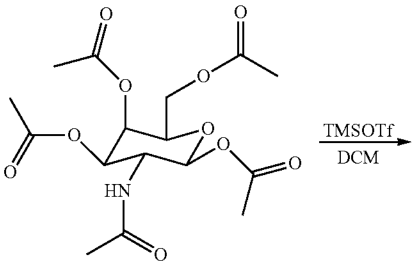

1

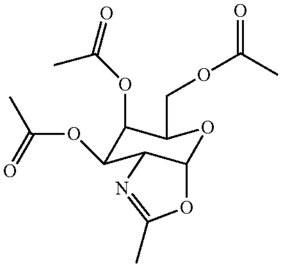

2

Preparation of compound 2: D-Galactosamine pentaacetate (3.00 g, 7.71 mmol, 1.0 eq.) was dissolved in anhydrous dichloromethane (DCM) (30 mL) under argon and trimethylsilyl trifluoromethanesulfonate (TMSOTf, 4.28 g, 19.27 mmol, 2.5 eq.) was added. The reaction was stirred at room temperature for 3 h. The reaction mixture was diluted with DCM (50 mL) and washed with cold saturated aq. $NaHCO_3$ (100 mL) and water (100 mL). The organic layer was separated, dried over $Na_2SO_4$ and concentrated to afford the title compound as yellow oil, which was purified by flash chromatography (gradient elution: 0-10% MeOH in DCM in 10 CV). The product was obtained as colourless oil (2.5 g, 98%, rf=0.45 (2% MeOH in DCM)).

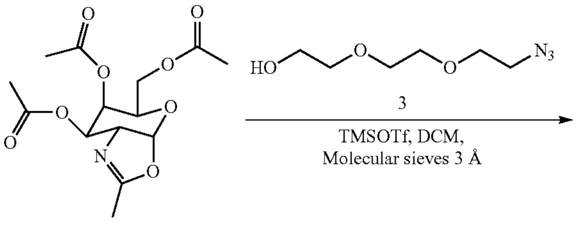

2

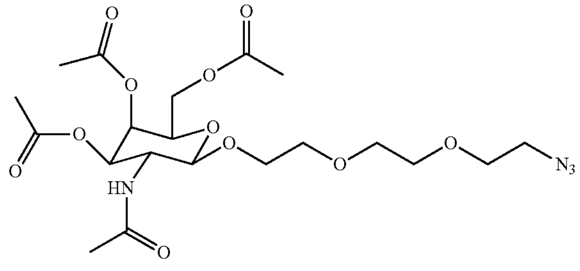

4

Preparation of compound 4: Compound 2 (2.30 g, 6.98 mmol, 1.0 eq.) and azido-PEG3-OH (1.83 g, 10.5 mmol, 1.5 eq.) were dissolved in anhydrous DCM (40 mL) under argon and molecular sieves 3 Å (5 g) were added to the solution. The mixture was stirred at room temperature for 1 h. TMSOTf (0.77 g, 3.49 mmol, 0.5 eq.) was then added to the mixture and the reaction was stirred overnight. The molecular sieves were filtered, the filtrate was diluted with DCM (100 mL) and washed with cold saturated aq. $NaHCO_3$ (100 mL) and water (100 mL). The organic layer was separated, dried over $Na_2SO_4$ and the solvent was removed under reduced pressure. The crude material was purified by flash chromatography (gradient elution: 0-3% MeCOH in DCM in 10 CV) to afford the title product as light yellow oil (3.10 g, 88%, rf=0.25 (2% MeOH in DCM)). MS: calculated for $C_{20}H_{32}N_4O_{11}$, 504.21. Found 505.4. $^1H$ NMR (500 MHz, $CDCl_3$) δ 6.21-6.14 (m, 1H), 5.30 (dd, J=3.4, 1.1 Hz, 1H), 5.04 (dd, J=11.2, 3.4 Hz, 1H), 4.76 (d, J=8.6 Hz, 1H), 4.23-4.08 (m, 3H), 3.91-3.80 (m, 3H), 3.74-3.59 (m, 9H), 3.49-3.41 (m, 2H), 2.14 (s, 3H), 2.02 (s, 3H), 1.97 (d, J=4.2 Hz, 6H). $^{13}C$ NMR (125 MHz, $CDCl_3$) δ 170.6 (C), 170.5 (C), 170.4 (C), 170.3 (C), 102.1 (CH), 71.6 (CH), 70.8 (CH), 70.6 (CH), 70.5 (CH), 70.3 ($CH_2$), 69.7 ($CH_2$), 68.5 ($CH_2$), 66.6 ($CH_2$), 61.5 ($CH_2$), 23.1 ($CH_3$), 20.7 ($3\times CH_3$).

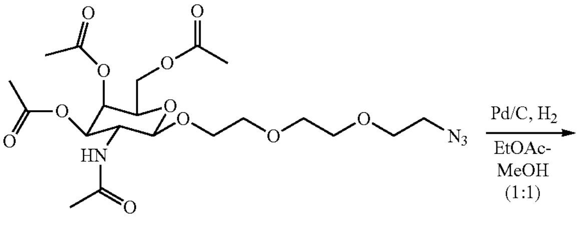

4

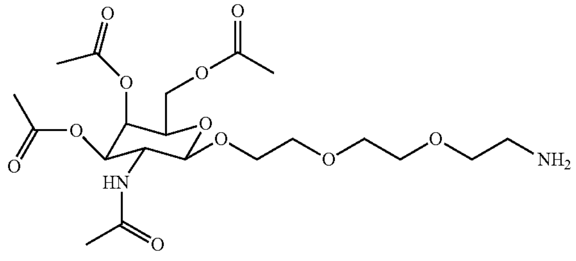

5

Preparation of compound 5: Compound 4 (1.00 g, 1.98 mmol, 1.0 eq.) was dissolved in a mixture of ethyl acetate (EtOAc) and MeOH (30 mL 1:1 v/v) and Pd/C (100 mg) was added. The reaction mixture was degassed using vacuum/argon cycles (3×) and hydrogenated under balloon pressure overnight. The reaction mixture was filtered through celite and washed with EtOAc (30 mL). The solvent was removed under reduced pressure to afford the title compound as colourless oil (0.95 g, quantitative yield, rf=0.25 (10% MeOH in DCM)). The compound was used without further purification. MS: calculated for $C_{20}H_{34}N_2O_{11}$, 478.2. Found 479.4.

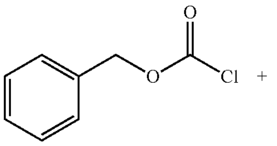

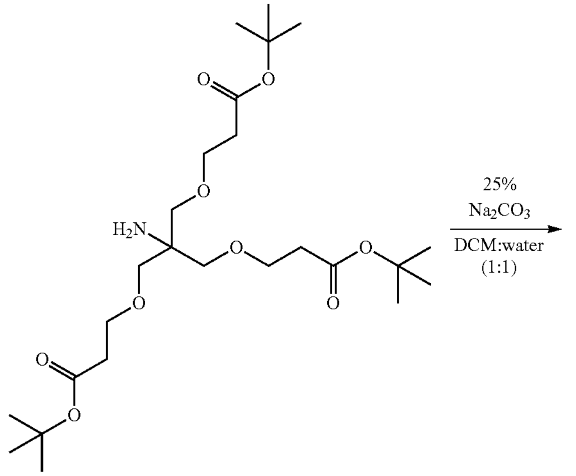

6

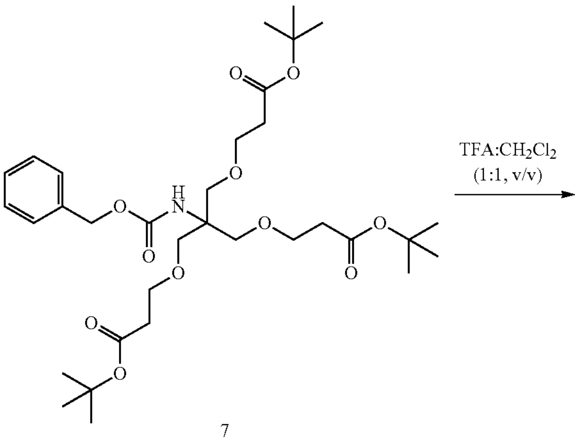

7

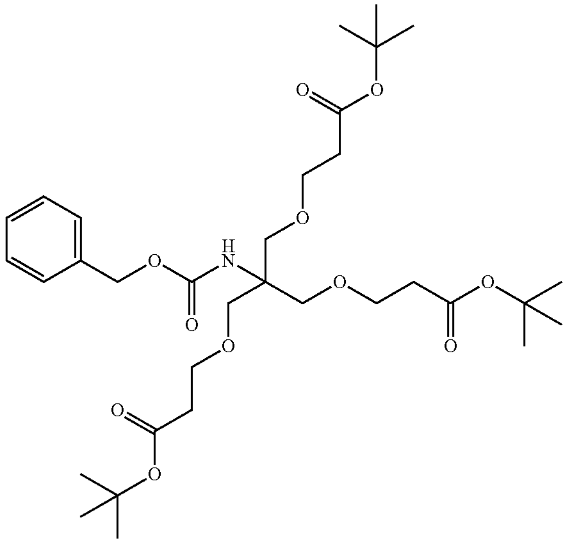

7

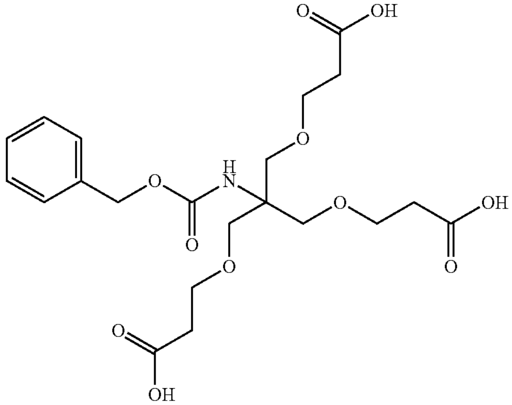

8

Preparation of compound 7: Tris{[2-(tert-butoxycarbonyl)ethoxy]methyl}-methylamine 6 (3.37 g, 6.67 mmol, 1.0 eq.) was dissolved in a mixture of DCM/water (40 mL 1:1 v/v) and $Na_2CO_3$ (0.18 g, 1.7 mmol, 0.25 eq.) was added while stirring vigorously. Benzyl chloroformate (2.94 mL, 20.7 mmol, 3.10 eq.) was added dropwise to the previous mixture and the reaction was stirred at room temperature for 24 h. The reaction mixture was diluted with $CH_2Cl_2$ (100 mL) and washed with water (100 mL). The organic layer was separated and dried over $Na_2SO_4$. The solvent was removed under reduced pressure and the resulting crude material was purified by flash chromatography (gradient elution: 0-10% EtOAc in cyclohexane in 12 CV) to afford the title compound as pale yellowish oil (3.9 g, 91%, rf=0.56 (10% EtOAc in cyclohexane)). MS: calculated for $C_{33}H_{53}NO_{11}$, 639.3. Found 640.9. $^1H$ NMR (500 MHz, DMSO-$d_6$) δ 7.38-7.26 (m, 5H), 4.97 (s, 2H), 3.54 (t, 6H), 3.50 (s, 6H), 2.38 (t, 6H), 1.39 (s, 27H). $^{13}C$ NMR (125 MHz, DMSO-$d_6$) δ 170.3 (3×C), 154.5 (C), 137.1 (C), 128.2 (2×CH), 127.7 (CH), 127.6 (2×CH), 79.7 (3×C), 68.4 (3×$CH_2$), 66.8 (3×$CH_2$), 64.9 (C), 58.7 ($CH_2$), 35.8 (3×$CH_2$), 27.7 (9×$CH_3$).

Preparation of compound 8: Cbz-NH-tris-Boc-ester 7 (0.20 g, 0.39 mmol, 1.0 eq.) was dissolved in $CH_2Cl_2$ (1 mL) under argon, trifluoroacetic acid (TFA, 1 mL) was added and the reaction was stirred at room temperature for 1 h. The solvent was removed under reduced pressure, the residue was co-evaporated 3 times with toluene (5 mL) and dried under high vacuum to get the compound as its TFA salt (0.183 g, 98%). The compound was used without further purification. MS: calculated for $C_{21}H_{29}NO_{11}$, 471.6. Found 472.4.

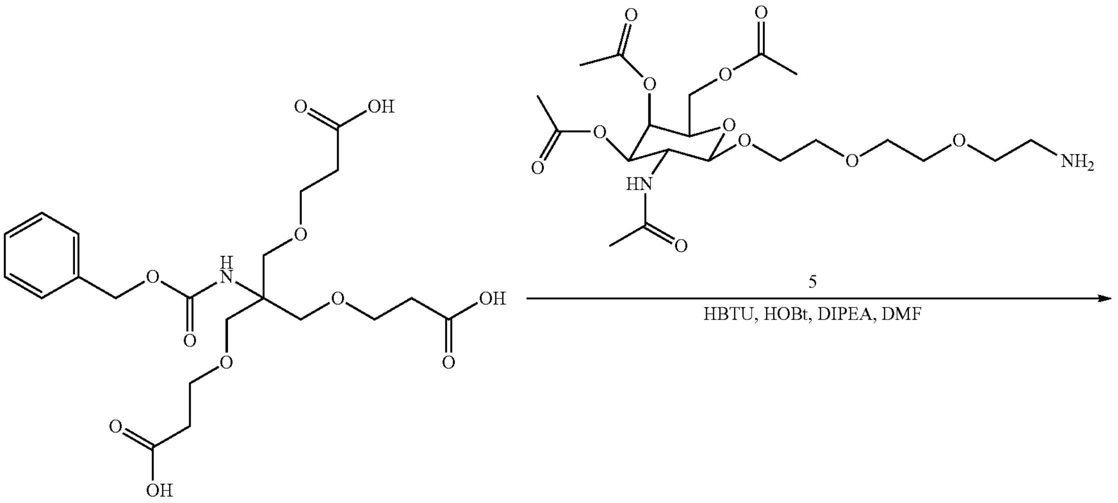

8

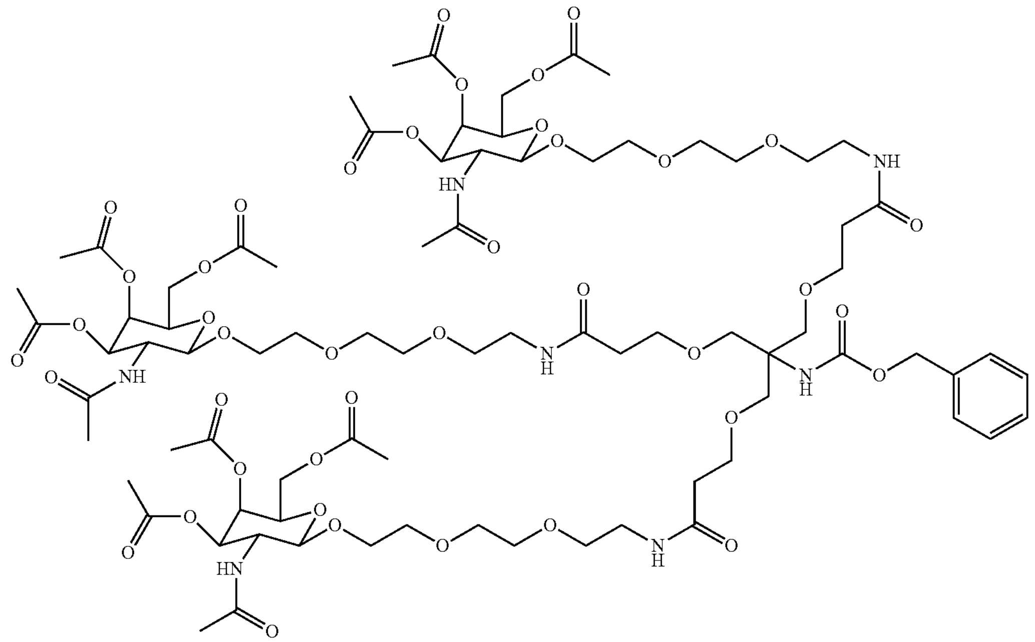

9

Preparation of compound 9: CbzNH-tris-COOH 8 (0.72 g, 1.49 mmol, 1.0 eq.) and GalNAc-PEG$_3$-NH$_2$ 5 (3.56 g, 7.44 mmol, 5.0 eq.) were dissolved in N,N-dimethylformamide (DMF) (25 mL). Then N,N,N',N'-tetramethyl-O-(1H-benzotriazol-1-yl)uronium hexafluorophosphate (HBTU) (2.78 g, 7.44 mmol, 5.0 eq.), 1-hydroxybenzotriazole hydrate (HOBt) (1.05 g, 7.44 mmol, 5.0 eq.) and N,N-diisopropylethylamine (DIPEA) (2.07 mL, 11.9 mmol, 8.0 eq.) were added to the solution and the reaction was stirred for 72 h. The solvent was removed under reduced pressure, the residue was dissolved in DCM (100 mL) and washed with saturated aq. NaHCO$_3$ (100 mL). The organic layer was dried over Na$_2$SO$_4$, the solvent evaporated and the crude material was purified by flash chromatography (gradient elution: 0-5% MeOH in DCM in 14 CV). The product was obtained as pale yellowish oil (1.2 g, 43%, rf=0.20 (5% MeOH in DCM)). MS: calculated for $C_{81}H_{125}N_7O_{41}$, 1852.9. Found 1854.7. $^1$H NMR (500 MHz, DMSO-d$_6$) δ 7.90-7.80 (m, 10H), 7.65-7.62 (m, 4H), 7.47-7.43 (m, 3H), 7.38-7.32 (m, 8H), 5.24-5.22 (m, 3H), 5.02-4.97 (m, 4H), 4.60-4.57 (m, 3H), 4.07-3.90 (m 10H), 3.67-3.36 (m, 70H), 3.23-3.07 (m, 25H), 2.18 (s, 10H), 2.00 (s, 13H), 1.89 (s, 11H), 1.80-1.78 (m, 17H). $^{13}$C NMR (125 MHz, DMSO-d$_6$) δ 170.1 (C), 169.8 (C), 169.7 (C), 169.4 (C), 169.2 (C), 169.1 (C), 142.7 (C), 126.3 (CH), 123.9 (CH), 118.7 (CH), 109.7 (CH), 100.8 (CH), 70.5 (CH), 69.8 (CH), 69.6 (CH), 69.5 (CH), 69.3 (CH$_2$), 69.0 (CH$_2$), 68.2 (CH$_2$), 67.2 (CH$_2$), 66.7 (CH$_2$), 61.4 (CH$_2$), 22.6 (CH$_2$), 22.4 (3×CH$_3$), 20.7 (9×CH$_3$).

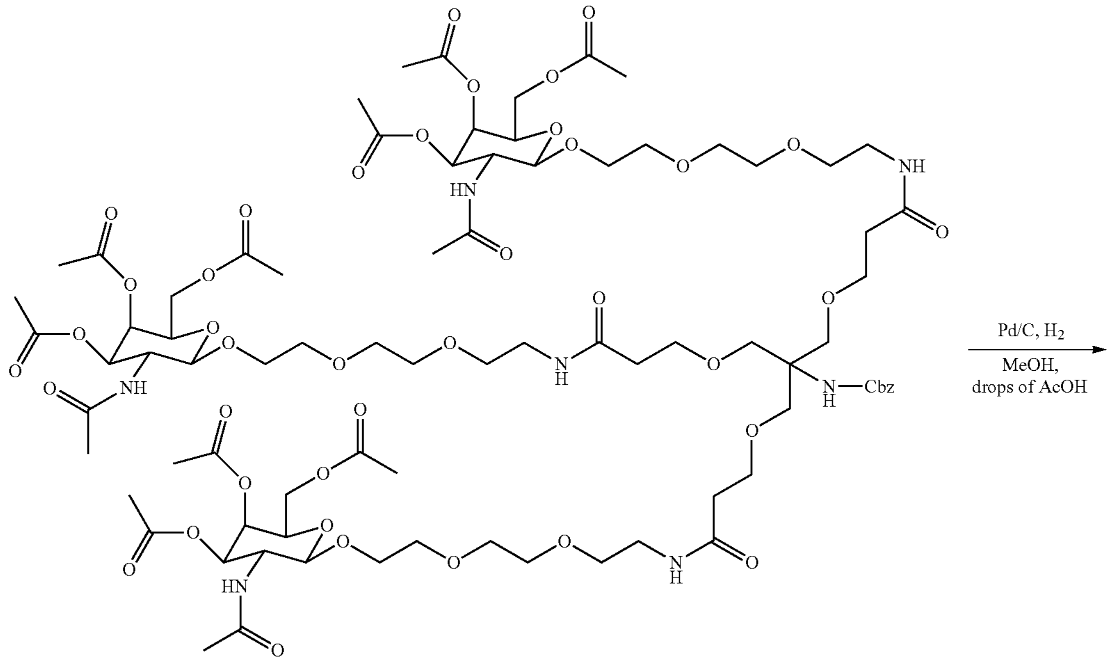
9
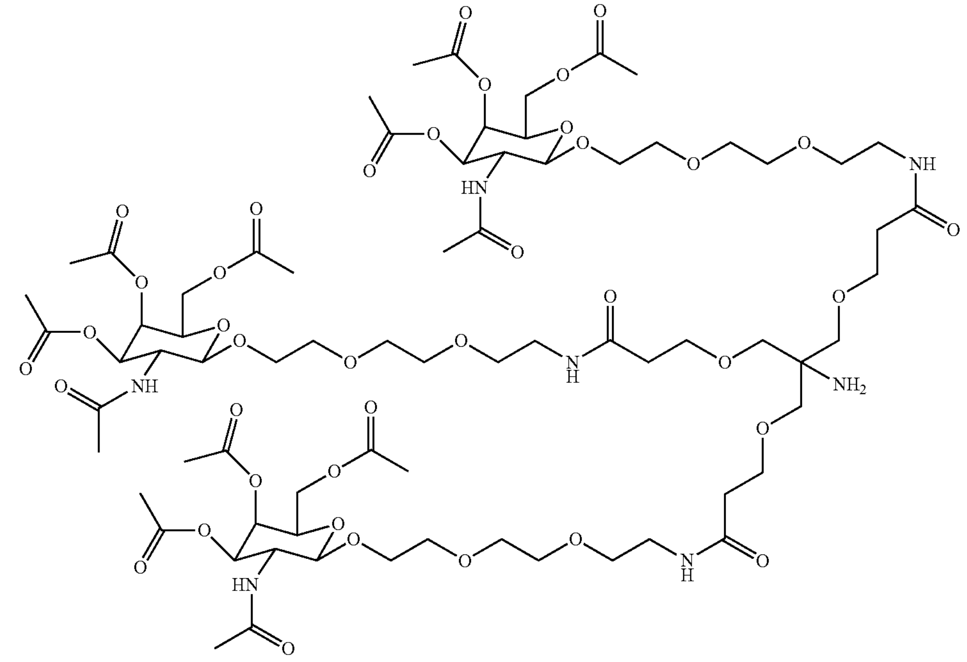
10

Preparation of compound 10: Triantennary GalNAc compound 9 (0.27 g, 0.14 mmol, 1.0 eq.) was dissolved in MeOH (15 mL), 3 drops of acetic acid (AcOH) and Pd/C (30 mg) was added. The reaction mixture was degassed using vacuum/argon cycles (3×) and hydrogenated under balloon pressure overnight. The completion of the reaction was followed by mass spectrometry and the resulting mixture was filtered through a thin pad of celite. The solvent was evaporated and the residue obtained was dried under high vacuum and used for the next step without further purification. The product was obtained as pale yellowish oil (0.24 g, quantitative yield). MS: calculated for $C_{73}H_{119}N_7O_{39}$, 1718.8. Found 1719.3.

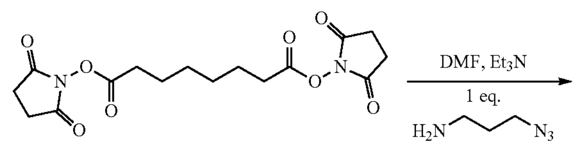

-continued

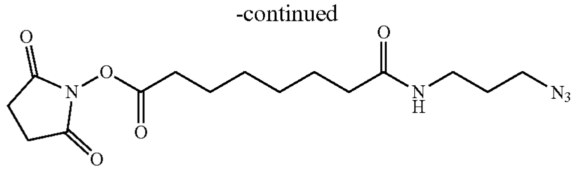

11

Preparation of compound 11: Commercially available suberic acid bis(N-hydroxysuccinimide ester) (3.67 g, 9.9 mmol, 1.0 eq.) was dissolved in DMF (5 mL) and triethylamine (1.2 mL) was added. To this solution was added dropwise a solution of 3-azido-1-propylamine (1.0 g, 9.9 mmol, 1.0 eq.) in DMF (5 mL). The reaction was stirred at room temperature for 3 h. The reaction mixture was diluted with EtOAc (100 mL) and washed with water (50 mL). The organic layer was separated, dried over $Na_2SO_4$ and the solvent was removed under reduced pressure. The crude material was purified by flash chromatography (gradient elution: 0-5% MeOH in DCM in 16 CV). The product was obtained as white solid (1.54 g, 43%, rf=0.71 (5% MeOH in DCM)). MS: calculated for $C_{15}H_{23}N_5O_5$, 353.4. Found 354.3.

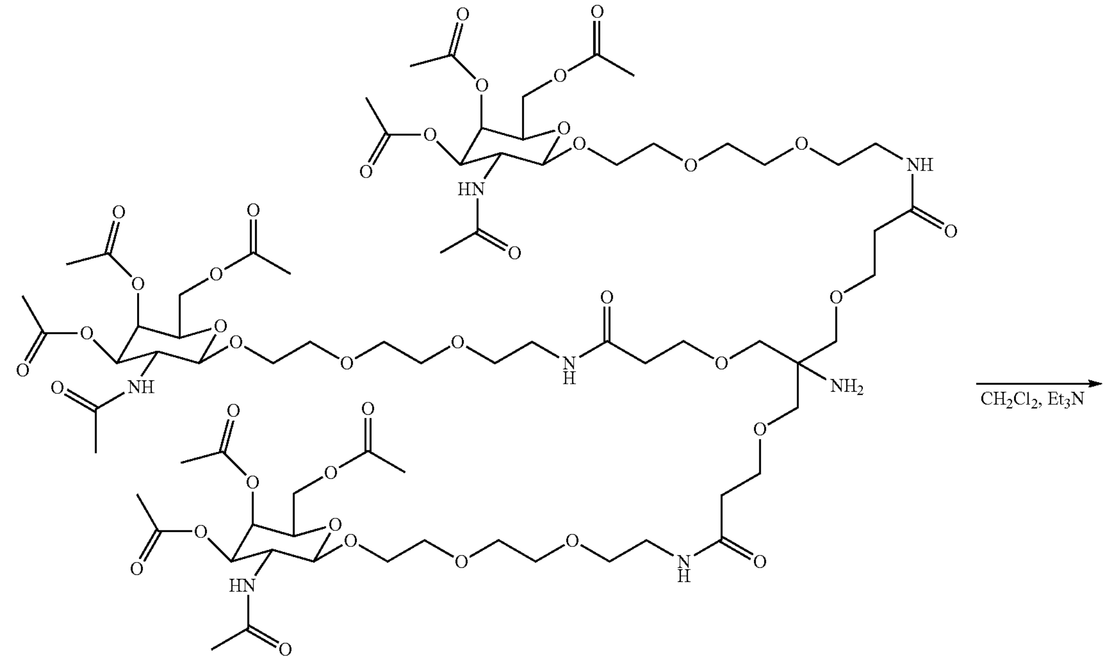

10

+

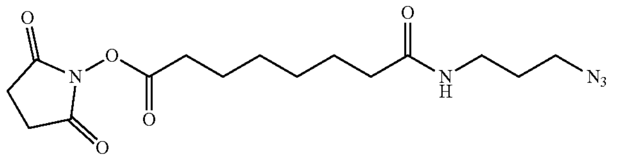

11

-continued

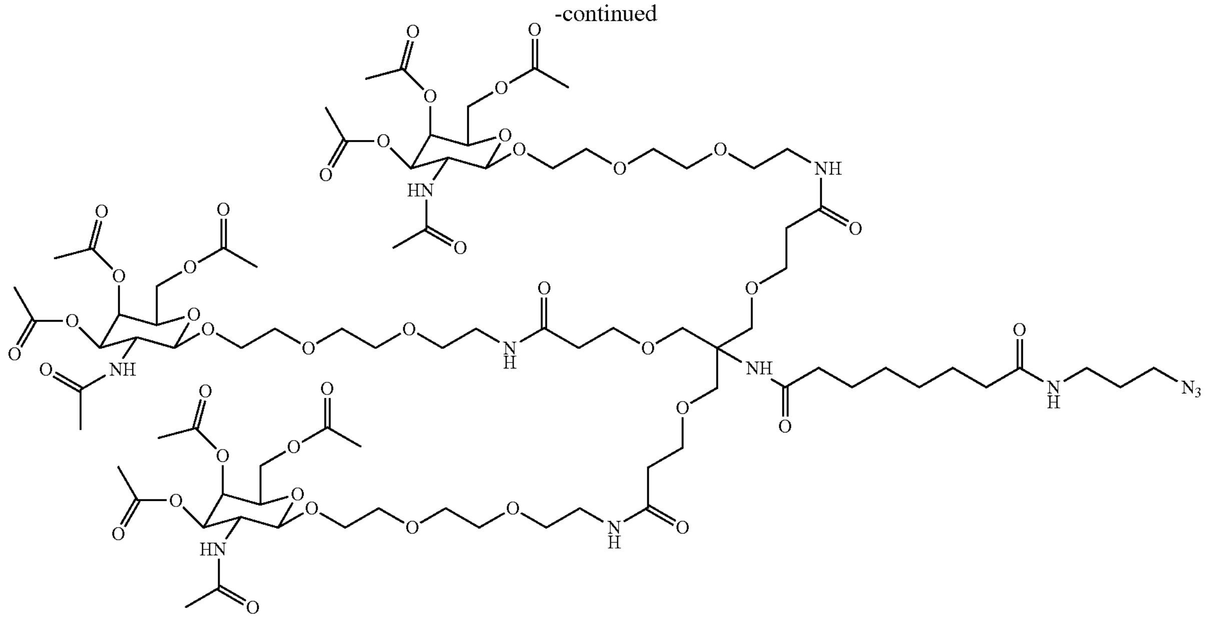

12

Preparation of TriGalNAc (12): Triantennary GalNAc compound 10 (0.35 g, 0.24 mmol, 1.0 eq.) and compound 11 (0.11 g, 0.31 mmol, 1.5 eq.) were dissolved in DCM (5 mL) under argon and triethylamine (0.1 mL, 0.61 mmol, 3.0 eq.) was added. The reaction was stirred at room temperature overnight. The solvent was removed under reduced pressure, the residue was dissolved in EtOAc (100 mL) and washed with water (100 mL). The organic layer was separated and dried over $Na_2SO_4$. The solvent was evaporated and the resulting crude material was purified by flash chromatography (elution gradient: 0-10% MeOH in DCM in 20 CV) to afford the title compound as white fluffy solid (0.27 g, 67%, rf=0.5 (10% MeOH in DCM)). MS: calculated for $C_{84}H_{137}N_{11}O_{41}$, 1957.1. Found 1959.6.

Conjugation of Tether 1 to a siRNA Strand: Monofluoro Cyclooctyne (MFCO) Conjugation at 5'- or 3'-End 5'-end MFCO conjugation

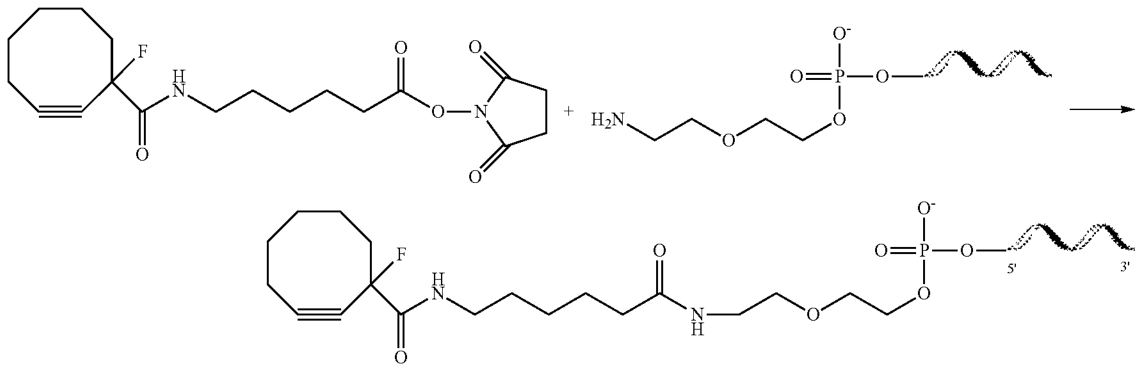

3'-end MFCO conjugation

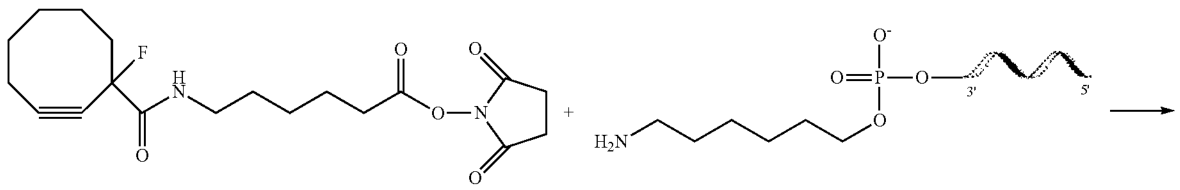

-continued

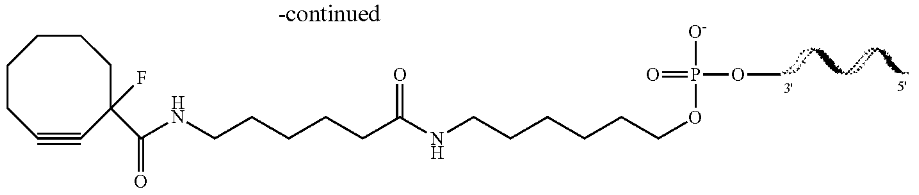

General conditions for MFCO conjugation: Amine-modified single strand was dissolved at 700 OD/mL in 50 mM carbonate/bicarbonate buffer pH 9.6/dimethyl sulfoxide (DMSO) 4:6 (v/v) and to this solution was added one molar equivalent of a 35 mM solution of MFCO-C6-NHS ester (Berry&Associates, Cat. #LK 4300) in DMF. The reaction was carried out at room temperature and after 1 h another molar equivalent of the MFCO solution was added. The reaction was allowed to proceed for an additional hour and was monitored by LC/MS. At least two molar equivalent excess of the MFCO NHS ester reagent relative to the amino modified oligonucleotide were needed to achieve quantitative consumption of the starting material. The reaction mixture was diluted 15-fold with water, filtered through a 1.2 μm filter from Sartorius and then purified by reserve phase (RP HPLC) on an Akta Pure instrument (GE Healthcare).

Purification was performed using a XBridge C18 Prep 19×50 mm column from Waters. Buffer A was 100 mM TEAAc pH 7 and buffer B contained 95% acetonitrile in buffer A. A flow rate of 10 mL/min and a temperature of 60° C. were employed. UV traces at 280 nm were recorded. A gradient of 0-100% B within 60 column volumes was employed.

Fractions containing full length conjugated oligonucleotide were pooled, precipitated in the freezer with 3 M NaOAc, pH 5.2 and 85% ethanol and the collected pellet was dissolved in water. Samples were desalted by size exclusion chromatography and concentrated using a speed-vac concentrator to yield the conjugated oligonucleotide in an isolated yield of 40-80%.

General procedure for TriGalNAc conjugation: MFCO-modified single strand was dissolved at 2000 OD/mL in water and to this solution was added one equivalent solution of compound 12 (10 mM) in DMF. The reaction was carried out at room temperature and after 3 h 0.7 molar equivalent of the compound 12 solution was added. The reaction was allowed to proceed overnight and completion was monitored by LCMS. The conjugate was diluted 15-fold in water, filtered through a 1.2 μm filter from Sartorius and then purified by RP HPLC on an Akta Pure instrument (GE Healthcare).

RP HPLC purification was performed using a XBridge C18 Prep 19×50 mm column from Waters. Buffer A was 100 mM triethylammonium acetate pH 7 and buffer B contained 95% acetonitrile in buffer A. A flow rate of 10 mL/min and a temperature of 60° C. were employed. UV traces at 280 nm were recorded. A gradient of 0-100% B within 60 column volumes was employed.

Fractions containing full-length conjugated oligonucleotide were pooled, precipitated in the freezer with 3 M NaOAc, pH 5.2 and 85% ethanol and the collected pellet was dissolved in water to give an oligonucleotide solution of about 1000 OD/mL. The O-acetates were removed by adding 20% aqueous ammonia. Quantitative removal of these protecting groups was verified by LC-MS.

The conjugates were desalted by size exclusion chromatography using Sephadex G25 Fine resin (GE Healthcare) on an Akta Pure (GE Healthcare) instrument to yield the conjugated oligonucleotides in an isolated yield of 50-70%.

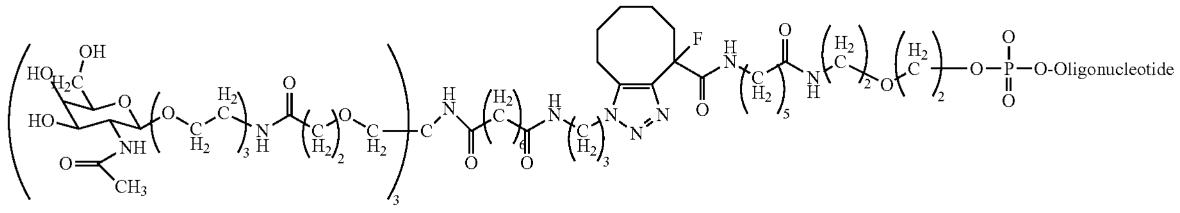

5′-GalNAc-T1 conjugates

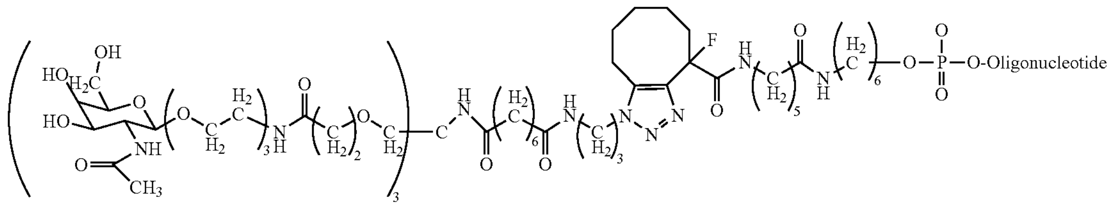

3′-GalNAc-T1 conjugates

The following schemes further set out the routes of synthesis:
Scheme 1
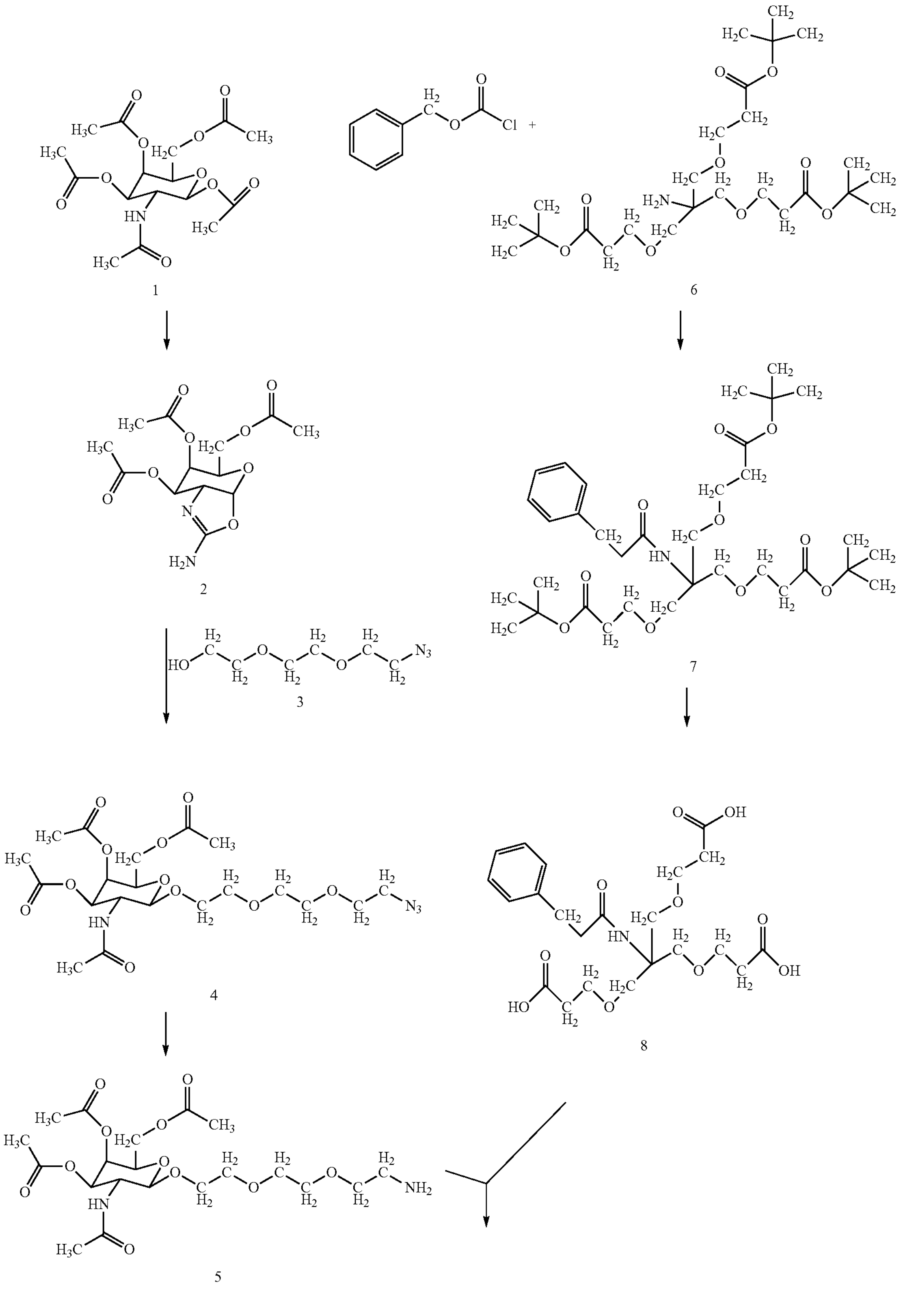
1
6
2
3
7
4
8
5

-continued
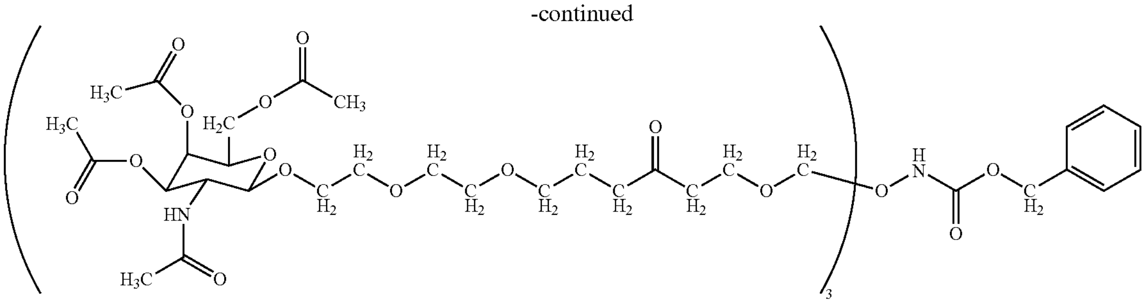
9
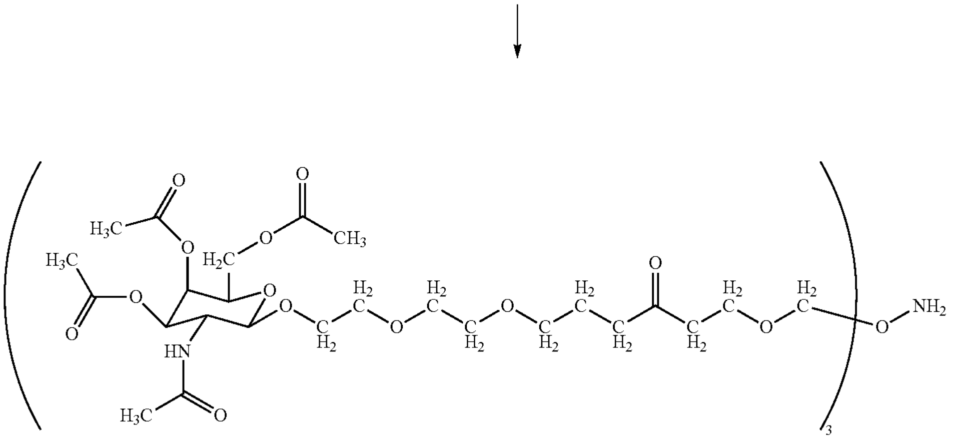
10
Scheme 2
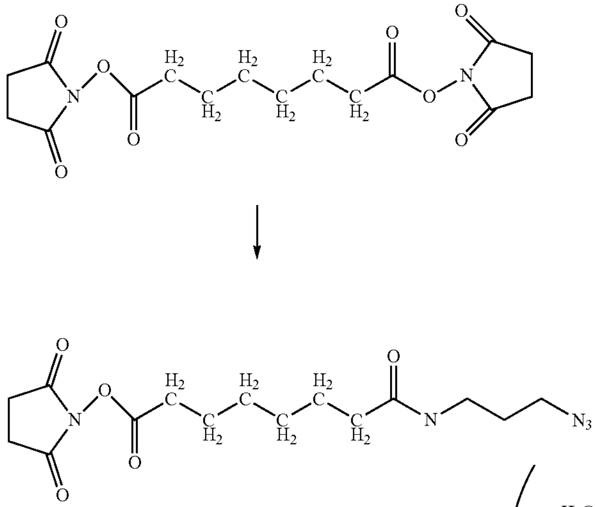
11
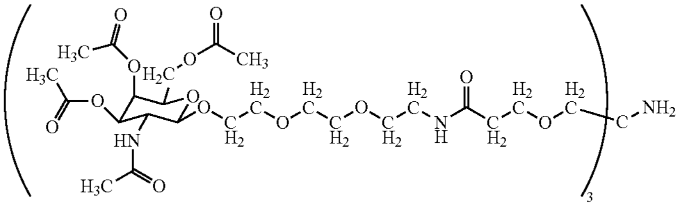
10
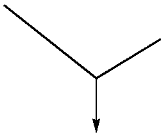

-continued
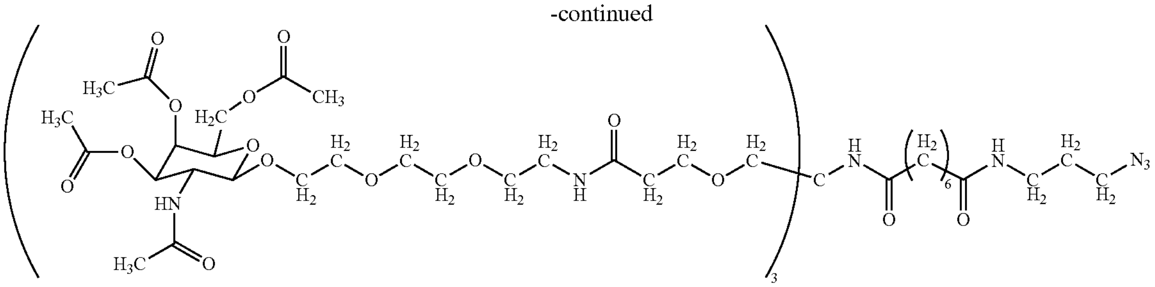
12
Scheme 3
5′ end MFCO conjugation
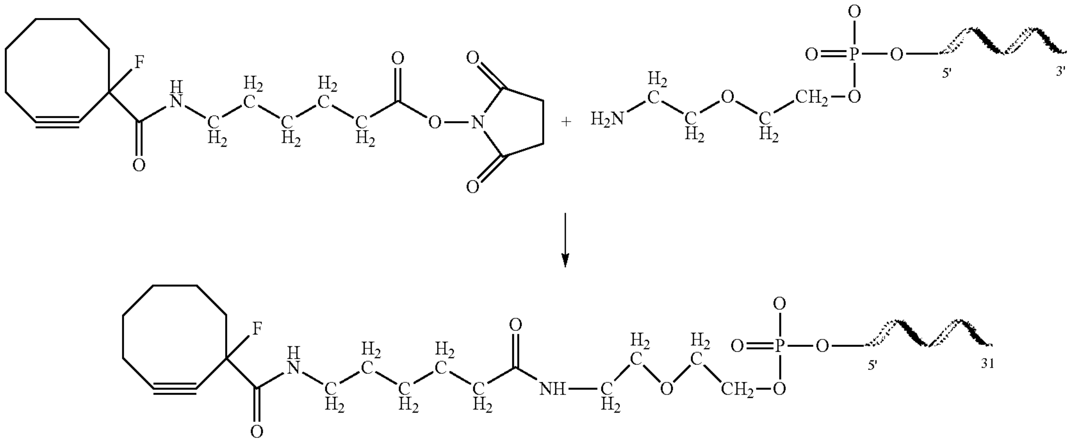
3′ end MFCO conjugation
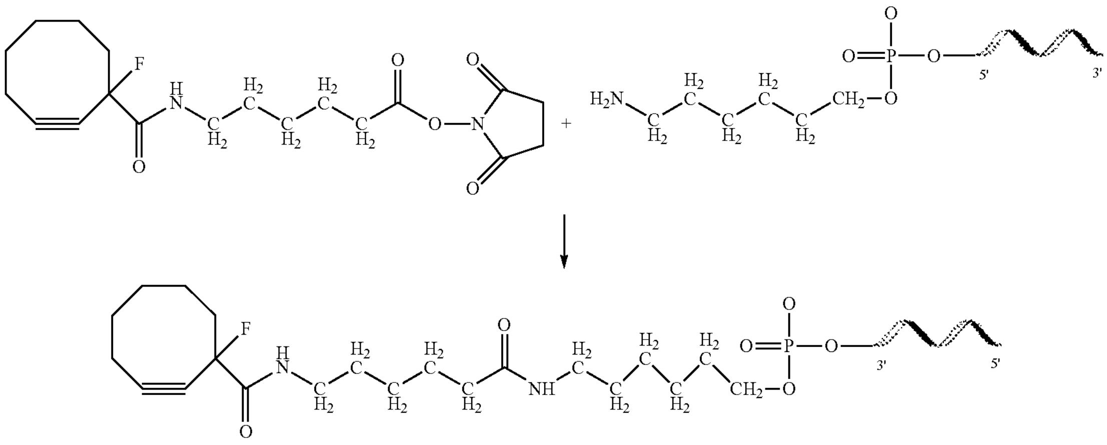

Scheme 4
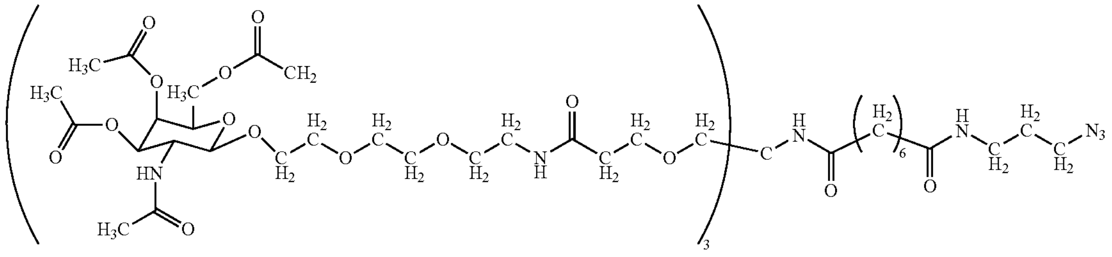
12
+
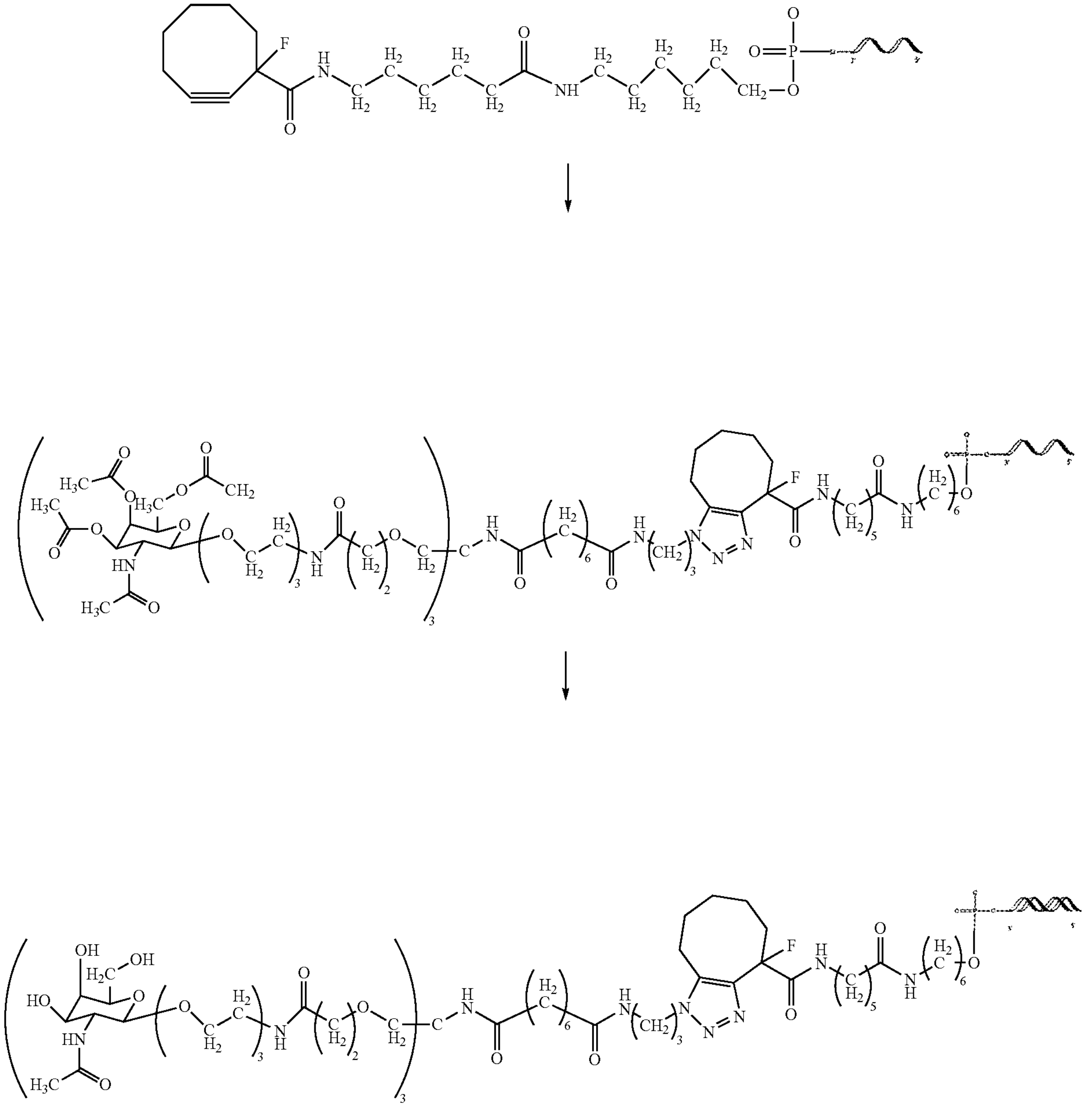

Scheme 5:

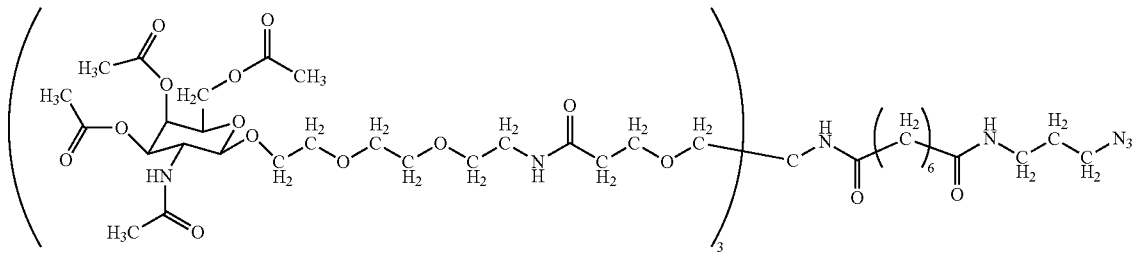

12

+

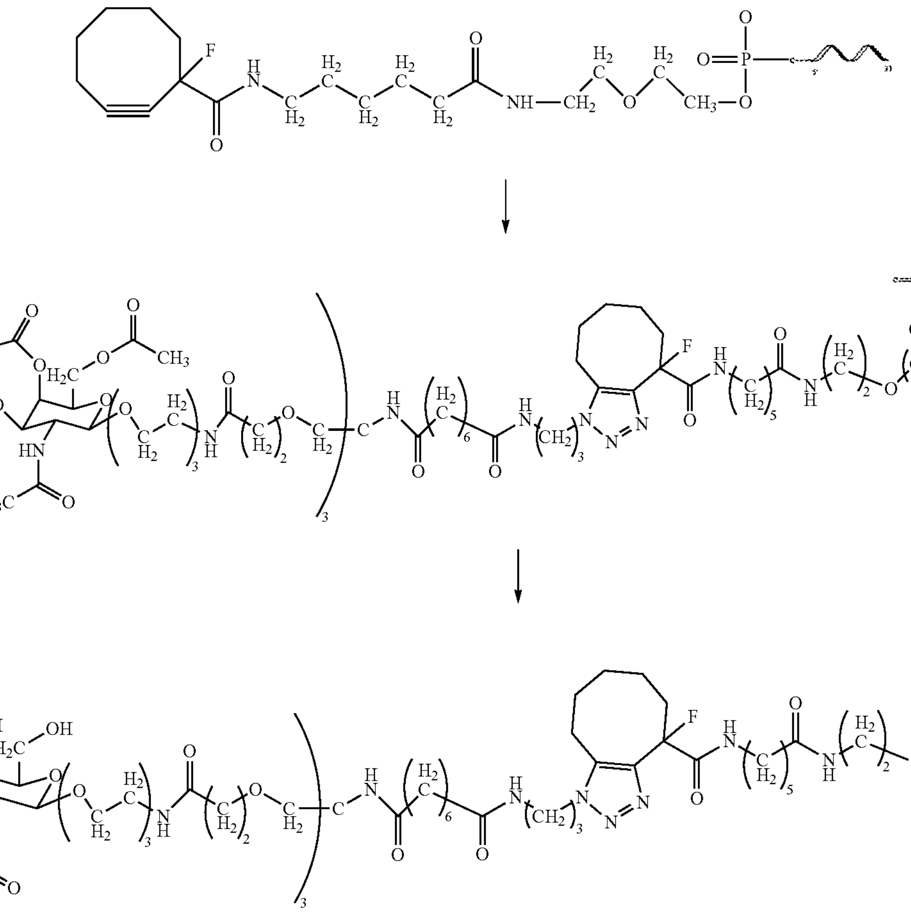

Example 3: Duplex Annealing

To generate the desired siRNA duplex, the two complementary strands were annealed by combining equimolar aqueous solutions of both strands. The mixtures were placed into a water bath at 70° C. for 5 minutes and subsequently allowed to cool to ambient temperature within 2 h. The duplexes were lyophilized for 2 days and stored at −20° C.

The duplexes were analyzed by analytical SEC HPLC on Superdex™ 75 Increase 5/150 GL column 5×153-158 mm (Cytiva) on a Dionex Ultimate 3000 (Thermo Fisher Scientific) HPLC system. Mobile phase consisted of 1×PBS containing 10% acetonitrile. An isocratic gradient was run in 10 min at a flow rate of 1.5 mL/min at room temperature. UV traces at 260 and 280 nm were recorded. Water (LC-MS grade) was purchased from Sigma-Aldrich and Phosphate-buffered saline (PBS; 10×, pH 7.4) was purchased from GIBCO (Thermo Fisher Scientific).

Example 4: Synthesis of Tether 2

General Experimental Conditions:

Thin layer chromatography (TLC) was performed on silica-coated aluminium plates with fluorescence indicator 254 nm from Macherey-Nagel. Compounds were visualized under UV light (254 nm), or after spraying with the 5% $H_2SO_4$ in methanol (MeOH) or ninhydrin reagent according to Stahl (from Sigma-Aldrich), followed by heating. Flash chromatography was performed with a Biotage Isolera One flash chromatography instrument equipped with a dual variable UV wavelength detector (200-400 nm) using Biotage Sfar Silica 10, 25, 50 or 100 g columns (Uppsala, Sweden).

All moisture-sensitive reactions were carried out under anhydrous conditions using dry glassware, anhydrous solvents, and argon atmosphere. All commercially available reagents were purchased from Sigma-Aldrich and solvents from Carl Roth GmbH+Co. KG. D-Galactosamine pentaacetate was purchased from AK scientific.

HPLC/ESI-MS was performed on a Dionex UltiMate 3000 RS UHPLC system and Thermo Scientific MSQ Plus Mass spectrometer using an Acquity UPLC Protein BEH C4 column from Waters (300 Å, 1.7 μm, 2.1×100 mm) at 60° C. The solvent system consisted of solvent A with $H_2O$ containing 0.1% formic acid and solvent B with acetonitrile (ACN) containing 0.1% formic acid. A gradient from 5-100% of B over 15 min with a flow rate of 0.4 mL/min was employed. Detector and conditions: Corona ultra-charged aerosol detection (from esa). Nebulizer Temp.: 25° C. $N_2$ pressure: 35.1 psi. Filter: Corona.

$^{1}$H and $^{13}$C NMR spectra were recorded at room temperature on a Varian spectrometer at 500 MHz ($^{1}$H NMR) and 125 MHz ($^{13}$C NMR). Chemical shifts are given in ppm referenced to the solvent residual peak ($CDCl_3$—$^{1}$H NMR: 6 at 7.26 ppm and $^{13}$C NMR 6 at 77.2 ppm; DMSO-$d_6$—$^{1}$H NMR: 6 at 2.50 ppm and $^{13}$C NMR 6 at 39.5 ppm). Coupling constants are given in Hertz. Signal splitting patterns are described as singlet (s), doublet (d), triplet (t) or multiplet (m).

Synthesis Route for the Conjugate Building Block TriGalNAc_Tether2:

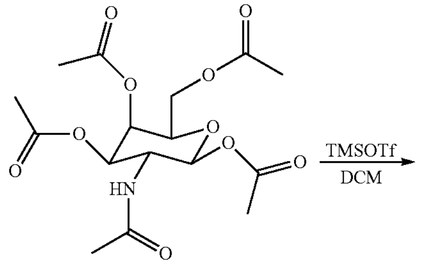

1

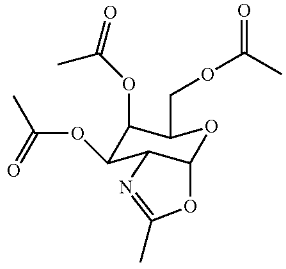

2

Preparation of compound 2: D-Galactosamine pentaacetate (3.00 g, 7.71 mmol, 1.0 eq.) was dissolved in anhydrous dichloromethane (DCM) (30 mL) under argon and trimethylsilyl trifluoromethanesulfonate (TMSOTf, 4.28 g, 19.27 mmol, 2.5 eq.) was added. The reaction was stirred at room temperature for 3 h. The reaction mixture was diluted with DCM (50 mL) and washed with cold saturated aq. $NaHCO_3$ (100 mL) and water (100 mL). The organic layer was separated, dried over $Na_2SO_4$, and concentrated to afford the title compound as yellow oil, which was purified by flash chromatography (gradient elution: 0-10% MeOH in DCM in 10 CV). The product was obtained as colourless oil (2.5 g, 98%, rf=0.45 (2% MeOH in DCM)).

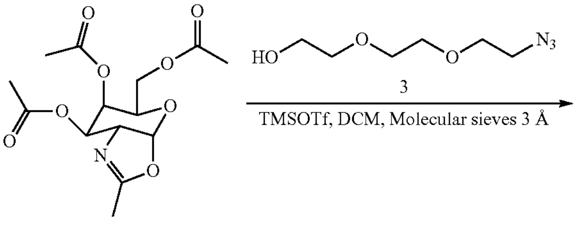

2

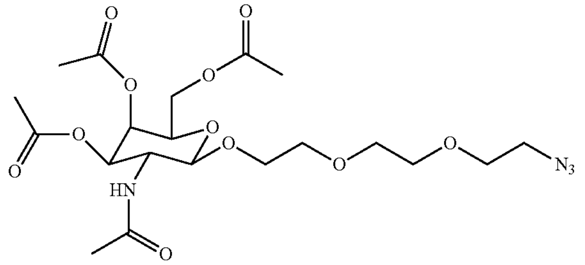

4

Preparation of compound 4: Compound 2 (2.30 g, 6.98 mmol, 1.0 eq.) and azido-PEG3-OH (1.83 g, 10.5 mmol, 1.5 eq.) were dissolved in anhydrous DCM (40 mL) under argon and molecular sieves 3 Å (5 g) were added to the solution. The mixture was stirred at room temperature for 1 h. TMSOTf (0.77 g, 3.49 mmol, 0.5 eq.) was then added to the mixture and the reaction was stirred overnight. The molecular sieves were filtered, the filtrate was diluted with DCM (100 mL) and washed with cold saturated aq. $NaHCO_3$ (100 mL) and water (100 mL). The organic layer was separated, dried over $Na_2SO_4$ and the solvent was removed under reduced pressure. The crude material was purified by flash chromatography (gradient elution: 0-3% MeOH in DCM in 10 CV) to afford the title product as light-yellow oil (3.10 g, 88%, rf=0.25 (2% MeOH in DCM)). MS: calculated for $C_{20}H_{32}N_4O_{11}$, 504.21. Found 505.4. $^{1}$H NMR (500 MHz, $CDCl_3$) δ 6.21-6.14 (m, 1H), 5.30 (dd, J=3.4, 1.1 Hz, 1H), 5.04 (dd, J=11.2, 3.4 Hz, 1H), 4.76 (d, J=8.6 Hz, 1H), 4.23-4.08 (m, 3H), 3.91-3.80 (m, 3H), 3.74-3.59 (m, 9H), 3.49-3.41 (m, 2H), 2.14 (s, 3H), 2.02 (s, 3H), 1.97 (d, J=4.2 Hz, 6H). $^{13}$C NMR (125 MHz, $CDCl_3$) δ 170.6 (C), 170.5 (C), 170.4 (C), 170.3 (C), 102.1 (CH), 71.6 (CH), 70.8 (CH), 70.6 (CH), 70.5 (CH), 70.3 ($CH_2$), 69.7 ($CH_2$), 68.5 ($CH_2$), 66.6 ($CH_2$), 61.5 ($CH_2$), 23.1 ($CH_3$), 20.7 (3×$CH_3$).

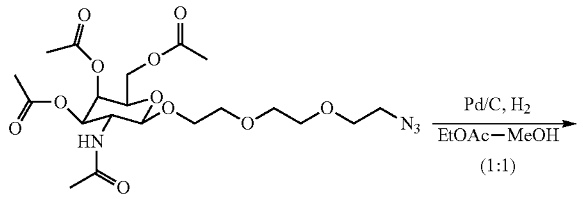

4

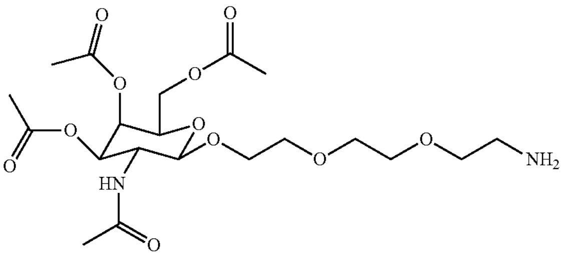

5

Preparation of compound 5: Compound 4 (1.00 g, 1.98 mmol, 1.0 eq.) was dissolved in a mixture of ethyl acetate (EtOAc) and MeOH (30 mL 1:1 v/v) and Pd/C (100 mg) was added. The reaction mixture was degassed using vacuum/argon cycles (3×) and hydrogenated under balloon pressure overnight. The reaction mixture was filtered through celite and washed with EtOAc (30 mL). The solvent was removed under reduced pressure to afford the title compound as colourless oil (0.95 g, quantitative yield, rf=0.25 (10% MeOH in DCM)). The compound was used without further purification. MS: calculated for $C_{20}H_{34}N_2O_{11}$, 478.2. Found 479.4.

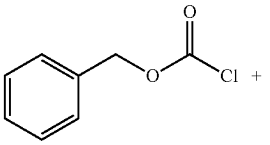

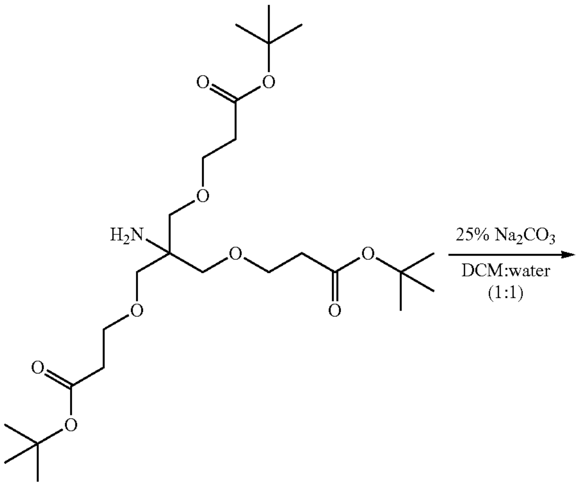

6

-continued

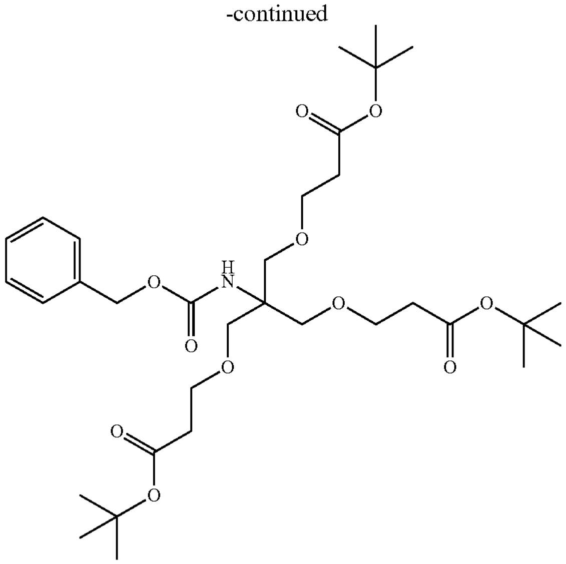

7

Preparation of compound 7: Tris{[2-(tert-butoxycarbonyl)ethoxy]methyl}-methylamine 6 (3.37 g, 6.67 mmol, 1.0 eq.) was dissolved in a mixture of DCM/water (40 mL 1:1 v/v) and $Na_2CO_3$ (0.18 g, 1.7 mmol, 0.25 eq.) was added while stirring vigorously. Benzyl chloroformate (2.94 mL, 20.7 mmol, 3.10 eq.) was added dropwise to the previous mixture and the reaction was stirred at room temperature for 24 h. The reaction mixture was diluted with $CH_2Cl_2$ (100 mL) and washed with water (100 mL). The organic layer was separated and dried over $Na_2SO_4$. The solvent was removed under reduced pressure and the resulting crude material was purified by flash chromatography (gradient elution: 0-10% EtOAc in cyclohexane in 12 CV) to afford the title compound as pale yellowish oil (3.9 g, 91%, rf=0.56 (10% EtOAc in cyclohexane)). MS: calculated for $C_{33}H_{53}NO_{11}$, 639.3. Found 640.9. $^1H$ NMR (500 MHz, DMSO-$d_6$) δ 7.38-7.26 (m, 5H), 4.97 (s, 2H), 3.54 (t, 6H), 3.50 (s, 6H), 2.38 (t, 6H), 1.39 (s, 27H). $^{13}C$ NMR (125 MHz, DMSO-$d_6$) δ 170.3 (3×C), 154.5 (C), 137.1 (C), 128.2 (2×CH), 127.7 (CH), 127.6 (2×CH), 79.7 (3×C), 68.4 (3×$CH_2$), 66.8 (3×$CH_2$), 64.9 (C), 58.7 ($CH_2$), 35.8 (3×$CH_2$), 27.7 (9×$CH_3$).

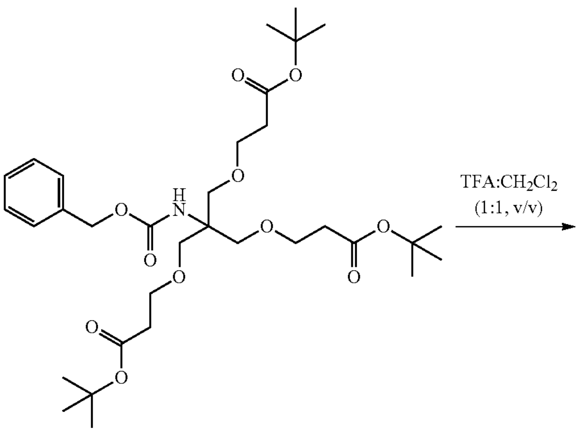

7

-continued

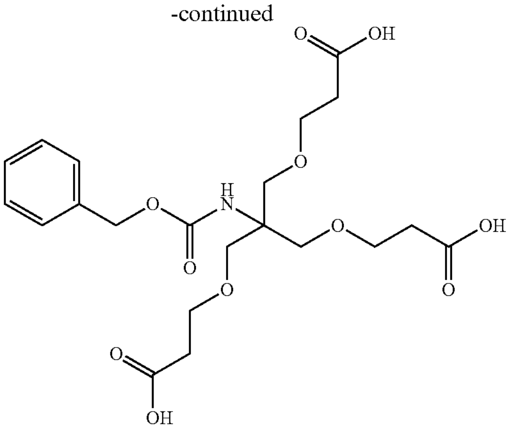

8

Preparation of compound 8: Cbz-NH-tris-Boc-ester 7 (0.20 g, 0.39 mmol, 1.0 eq.) was dissolved in $CH_2Cl_2$ (1 mL) under argon, trifluoroacetic acid (TFA, 1 mL) was added and the reaction was stirred at room temperature for 1 h. The solvent was removed under reduced pressure, the residue was co-evaporated 3 times with toluene (5 mL) and dried under high vacuum to get the compound as its TFA salt (0.183 g, 98%). The compound was used without further purification. MS: calculated for $C_{21}H_{29}NO_{11}$, 471.6. Found 472.4.

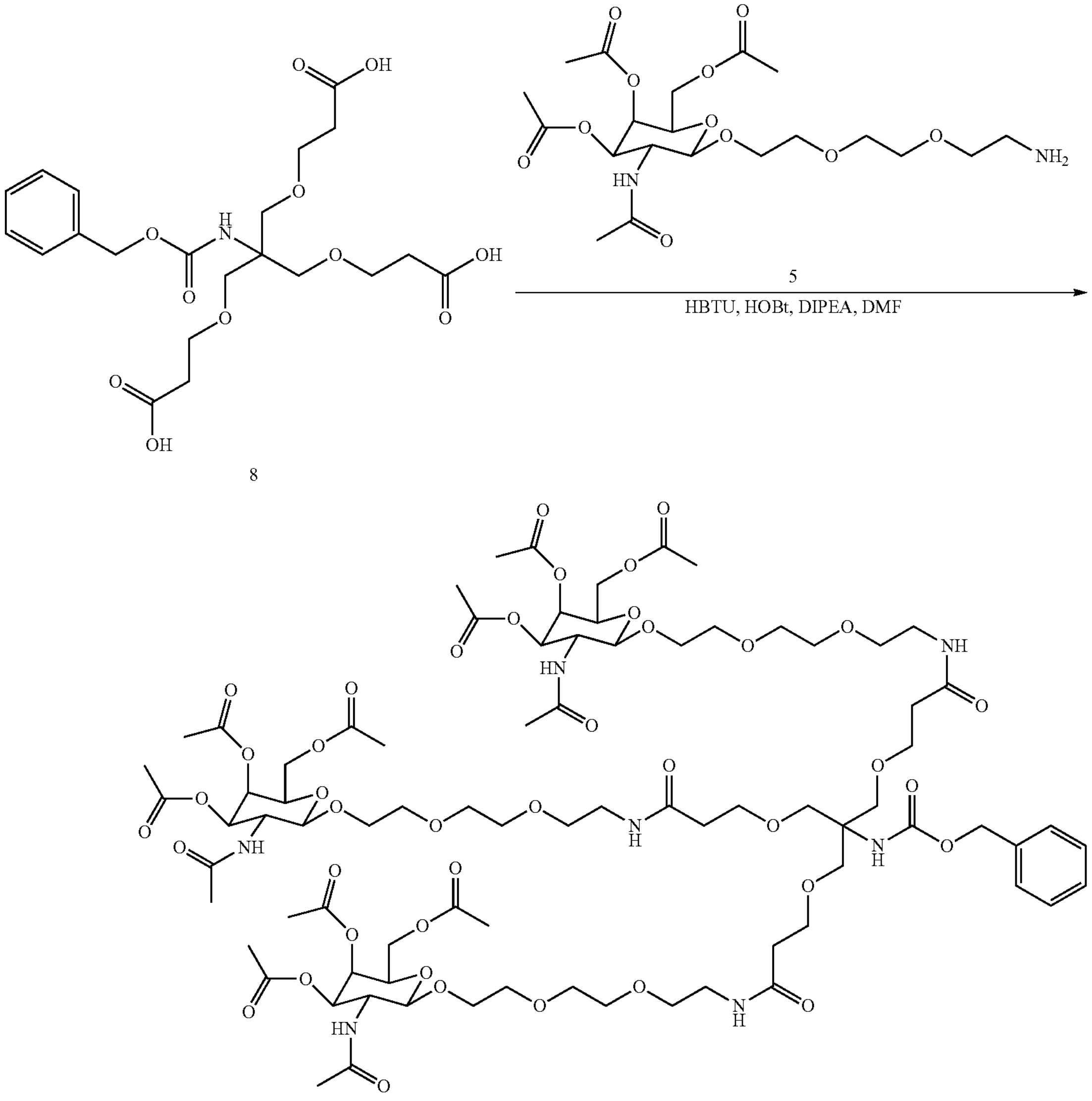

8

9

Preparation of compound 9: CbzNH-tris-COOH 8 (0.72 g, 1.49 mmol, 1.0 eq.) and GalNAc-$PEG_3$-$NH_2$ 5 (3.56 g, 7.44 mmol, 5.0 eq.) were dissolved in N,N-dimethylformamide (DMF) (25 mL). Then N,N,N',N'-tetramethyl-O-(1H-benzotriazol-1-yl)uronium hexafluorophosphate (HBTU) (2.78 g, 7.44 mmol, 5.0 eq.), 1-hydroxybenzotriazole hydrate (HOBt) (1.05 g, 7.44 mmol, 5.0 eq.) and N,N-diisopropylethylamine (DIPEA) (2.07 mL, 11.9 mmol, 8.0 eq.) were added to the solution and the reaction was stirred for 72 h. The solvent was removed under reduced pressure, the residue was dissolved in DCM (100 mL) and washed with saturated aq. $NaHCO_3$ (100 mL). The organic layer was dried over $Na_2SO_4$, the solvent evaporated and the crude material was purified by flash chromatography (gradient elution: 0-5% MeOH in DCM in 14 CV). The product was obtained as pale yellowish oil (1.2 g, 43%, rf=0.20 (5% MeOH in DCM)). MS: calculated for $C_{81}H_{125}N_7O_{41}$, 1852.9. Found 1854.7. $^1H$ NMR (500 MHz, DMSO-$d_6$) δ 7.90-7.80 (m, 10H), 7.65-7.62 (m, 4H), 7.47-7.43 (m, 3H), 7.38-7.32 (m, 8H), 5.24-5.22 (m, 3H), 5.02-4.97 (m, 4H), 4.60-4.57 (m, 3H), 4.07-3.90 (m 10H), 3.67-3.36 (m, 70H), 3.23-3.07 (m, 25H), 2.18 (s, 10H), 2.00 (s, 13H), 1.89 (s, 11H), 1.80-1.78 (m, 17H). $^{13}C$ NMR (125 MHz, DMSO-$d_6$) δ 170.1 (C), 169.8 (C), 169.7 (C), 169.4 (C), 169.2 (C), 169.1 (C), 142.7 (C), 126.3 (CH), 123.9 (CH), 118.7 (CH), 109.7 (CH), 100.8 (CH), 70.5 (CH), 69.8 (CH), 69.6 (CH), 69.5 (CH), 69.3 ($CH_2$), 69.0 ($CH_2$), 68.2 ($CH_2$), 67.2 ($CH_2$), 66.7 ($CH_2$), 61.4 ($CH_2$), 22.6 ($CH_2$), 22.4 (3×$CH_3$), 20.7 (9×$CH_3$).

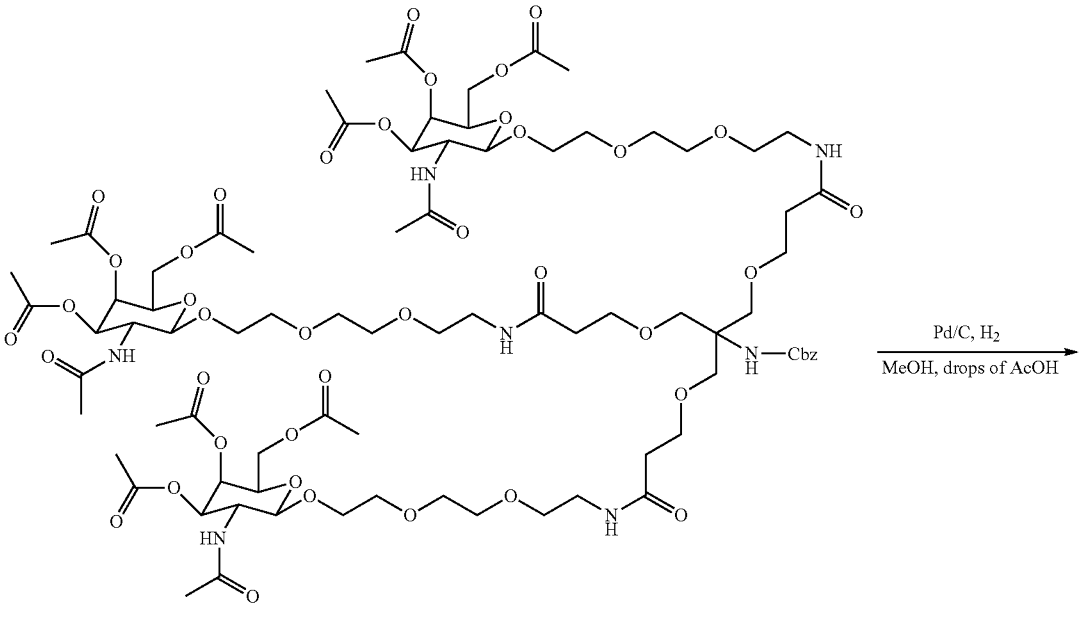

9

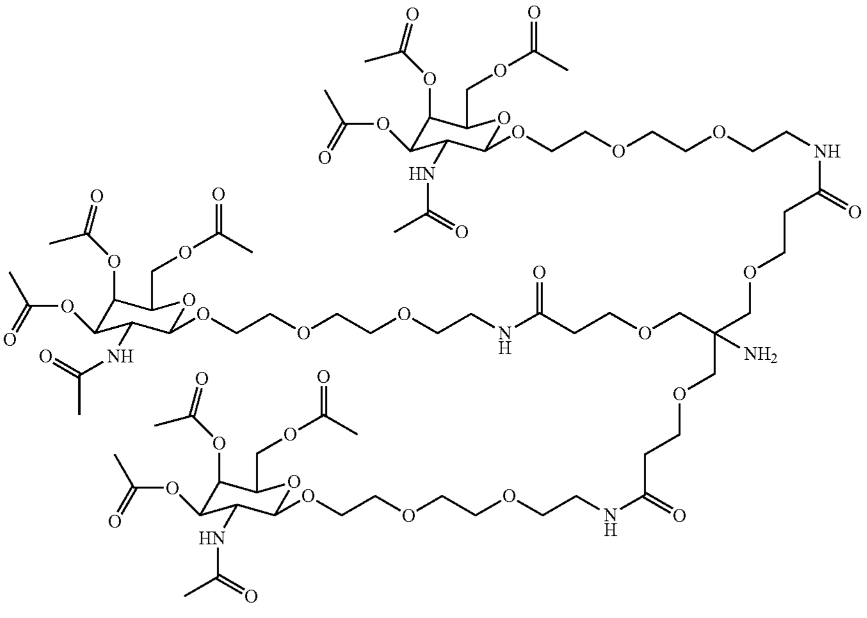

10

Preparation of compound 10: Triantennary GalNAc compound 9 (0.27 g, 0.14 mmol, 1.0 eq.) was dissolved in MeOH (15 mL), 3 drops of acetic acid (AcOH) and Pd/C (30 mg) was added. The reaction mixture was degassed using vacuum/argon cycles (3×) and hydrogenated under balloon pressure overnight. The completion of the reaction was followed by mass spectrometry and the resulting mixture was filtered through a thin pad of celite. The solvent was evaporated, and the residue obtained was dried under high vacuum and used for the next step without further purification. The product was obtained as pale yellowish oil (0.24 g, quantitative yield). MS: calculated for $C_{73}H_{119}N_7O_3 9$, 1718.8. Found 1719.3.

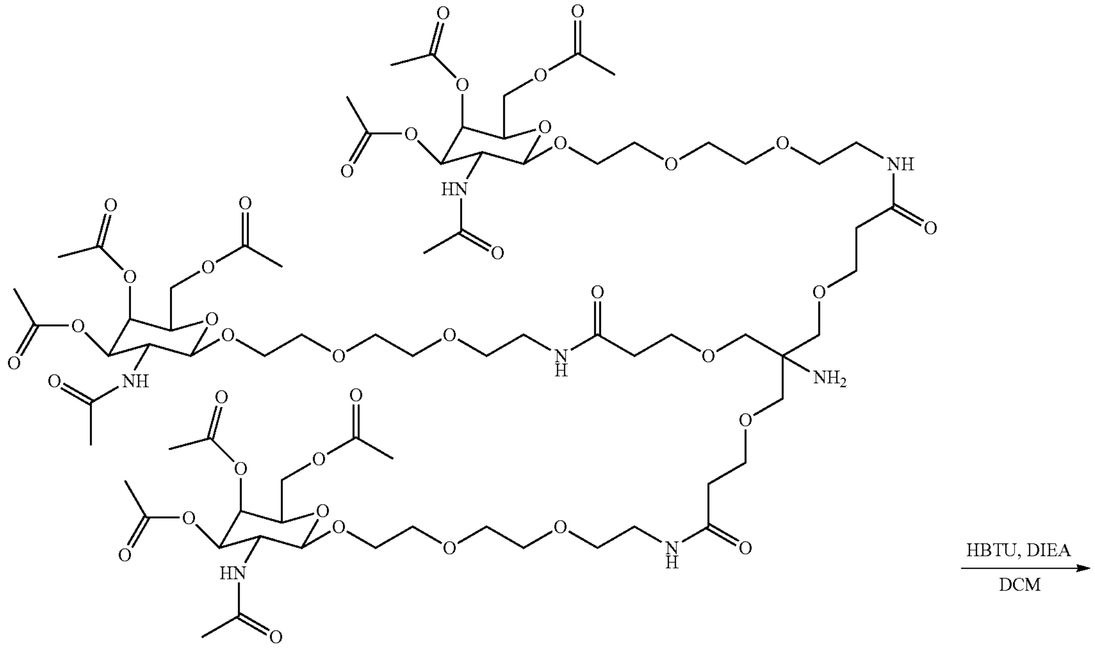

10

+

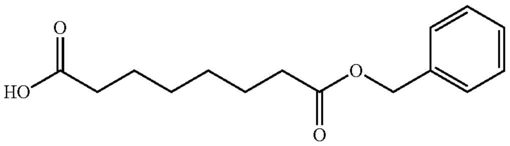

13

-continued

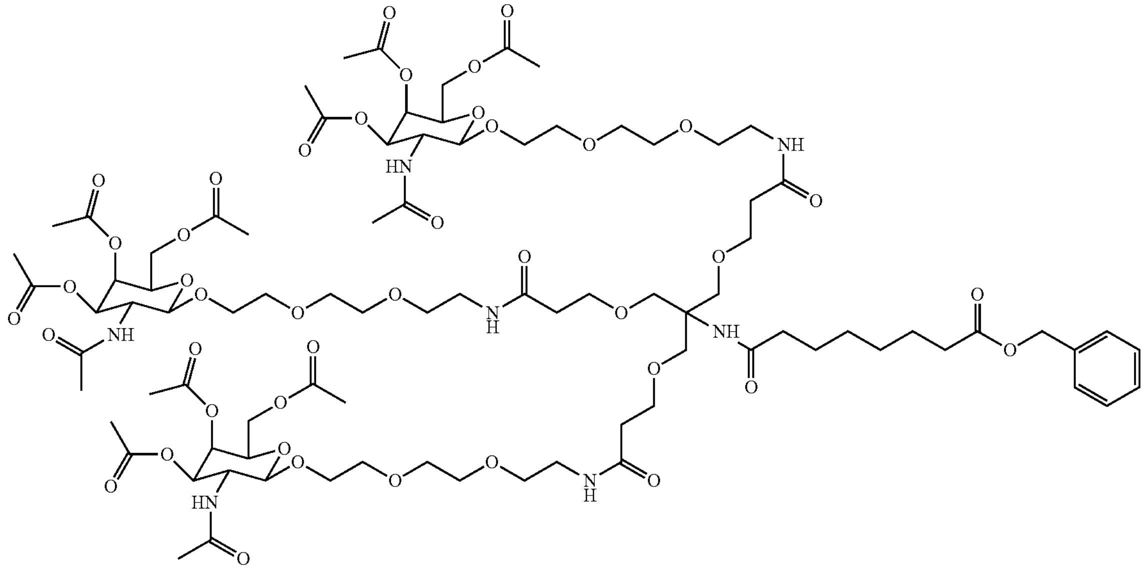

14

Preparation of compound 14: Triantennary GalNAc compound 10 (0.45 g, 0.26 mmol, 1.0 eq.), HBTU (0.19 g, 0.53 mmol, 2.0 eq.) and DIPEA (0.23 mL, 1.3 mmol, 5.0 eq.) were dissolved in DCM (10 mL) under argon. To this mixture, it was added dropwise a solution of compound 13 (0.14 g, 0.53 mmol, 2.0 eq.) in DCM (5 mL). The reaction was stirred at room temperature overnight. The solvent was removed, and the residue was dissolved in EtOAc (50 mL), washed with water (50 mL) and dried over $Na_2SO_4$. The solvent was evaporated, and the crude material was purified by flash chromatography (gradient elution: 0-5% MeOH in DCM in 20 CV). The product was obtained as white fluffy solid (0.25 g, 48%, rf=0.4 (10% MeOH in DCM)). MS: calculated for C88H137N7O42, 1965.1. Found 1965.6.

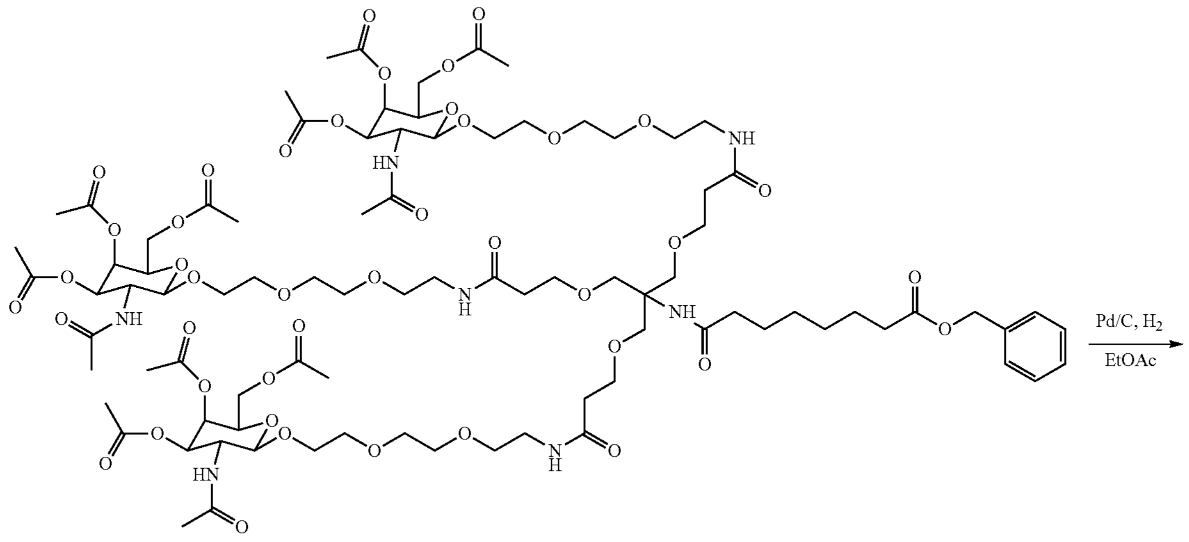

14

-continued

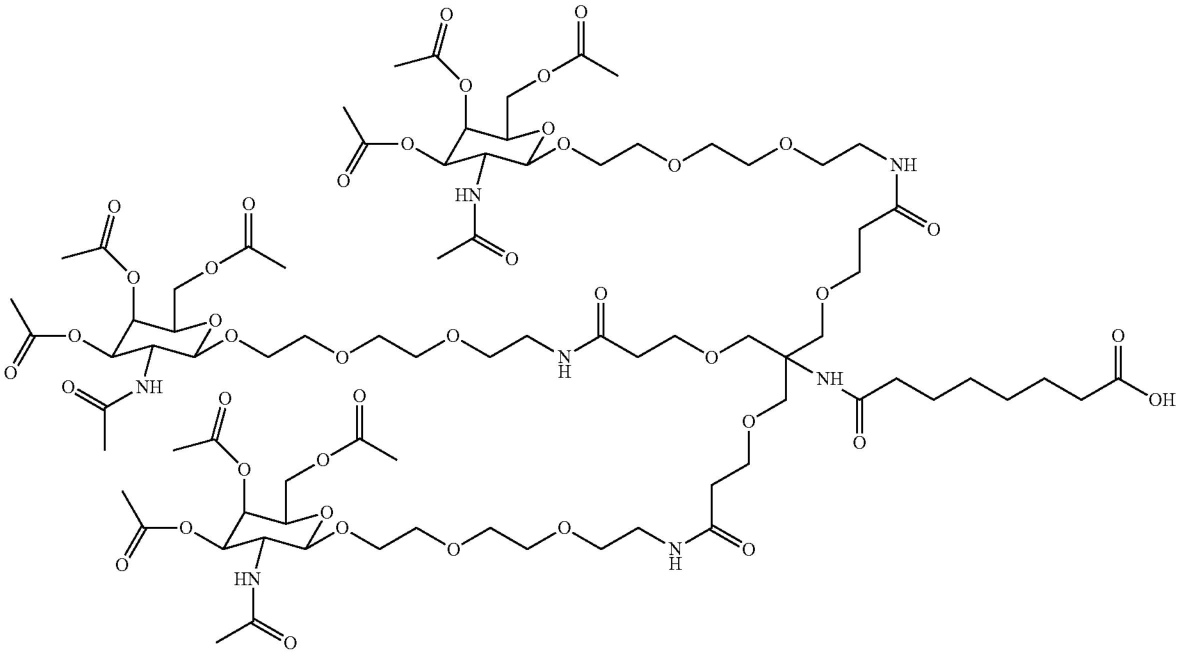

15

Preparation of TriGalNAc (15): Triantennary GalNAc compound 14 (0.31 g, 0.15 mmol, 1.0 eq.) was dissolved in EtOAc (15 mL) and Pd/C (40 mg) was added. The reaction mixture was degassed by using vacuum/argon cycles (3×) and hydrogenated under balloon pressure overnight. The completion of the reaction was monitored by mass spectrometry and the resulting mixture was filtered through a thin pad of celite. The solvent was removed under reduced pressure and the resulting residue was dried under high vacuum overnight. The residue was used for conjugations to oligonucleosides without further purification (0.28 g, quantitative yield). MS: calculated for $C_{81}H_{131}N_7O_{42}$, 1874.9. Found 1875.3.

Conjugation of Tether 2 to a siRNA Strand: TriGalNAc Tether 2 (GalNAc-T2) Conjugation at 5'-End or 3'-End

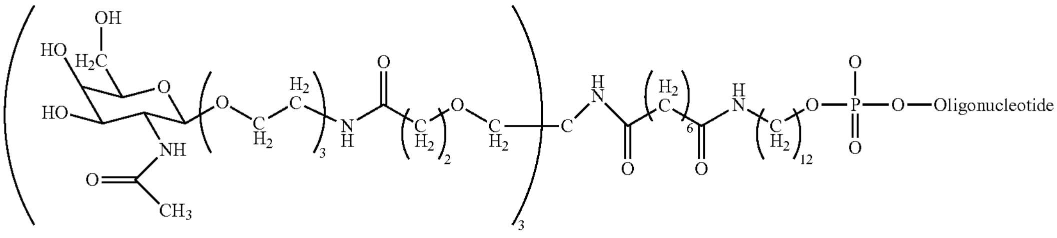

5'-GalNAc-T2 conjugates

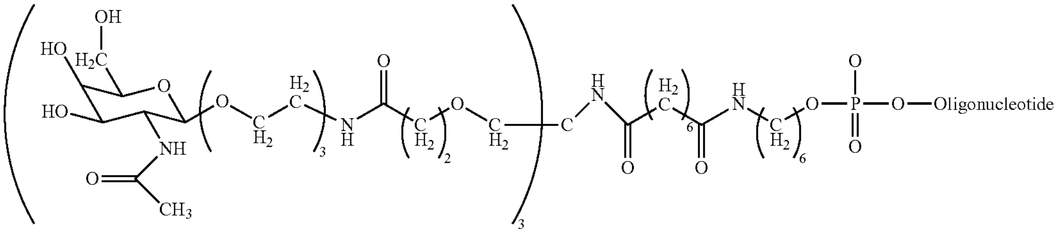

3'-GalNAc-T2 conjugates

Preparation of TriGalNAc tether 2 NHS ester: To a solution of carboxylic acid tether 2 (compound 15, 227 mg, 121 μmol) in DMF (2.1 mL), N-hydroxysuccinimide (NHS) (15.3 mg, 133 μmol) and N,N'-diisopropylcarbodiimide (DIC) (19.7 μL, 127 μmol) were added. The solution was stirred at room temperature for 18 h and used without purification for the subsequent conjugation reactions.

General procedure for triGalNAc tether 2 conjugation: Amine-modified single strand was dissolved at 700 OD/mL in 50 mM carbonate/bicarbonate buffer pH 9.6/DMSO 4:6 (v/v) and to this solution was added one molar equivalent of Tether 2 NHS ester (57 mM) solution in DMF. The reaction was carried out at room temperature and after 1 h another molar equivalent of the NHS ester solution was added. The reaction was allowed to proceed for one more hour and reaction progress was monitored by LCMS. At least two molar equivalent excess of the NHS ester reagent relative to the amino modified oligonucleoside were needed to achieve quantitative consumption of the starting material. The reaction mixture was diluted 15-fold with water, filtered once through 1.2 μm filter from Sartorius and then purified by reserve phase (RP HPLC) on an Akta Pure (GE Healthcare) instrument.

The purification was performed using a XBridge C18 Prep 19×50 mm column from Waters. Buffer A was 100 mM TEAA pH 7 and buffer B contained 95% acetonitrile in buffer A. A flow rate of 10 mL/min and a temperature of 60° C. were employed. UV traces at 280 nm were recorded. A gradient of 0-100% B within 60 column volumes was employed.

Fractions containing full-length conjugated oligonucleosides were pooled together, precipitated in the freezer with 3 M NaOAc, pH 5.2 and 85% ethanol and then dissolved at 1000 OD/mL in water. The 0-acetates were removed with 20% ammonium hydroxide in water until completion (monitored by LC-MS).

The conjugates were desalted by size exclusion chromatography using Sephadex G25 Fine resin (GE Healthcare) on an Akta Pure (GE Healthcare) instrument to yield the conjugated oligonucleotides in an isolated yield of 60-80%.

The conjugates were characterized by HPLC-MS analysis with a 2.1×50 mm XBridge C18 column (Waters) on a Dionex Ultimate 3000 (Thermo Fisher Scientific) HPLC system equipped with a Compact ESI-Qq-TOF mass spectrometer (Bruker Daltonics). Buffer A was 16.3 mM triethylamine, 100 mM HFIP in 1% MeOH in H2O and buffer B contained 95% MeCOH in buffer A. A flow rate of 250 μL/min and a temperature of 60° C. were employed. UV traces at 260 and 280 nm were recorded. A gradient of 1-100% B within 31 min was employed.

The following schemes further set out the routes of synthesis:

Scheme 6

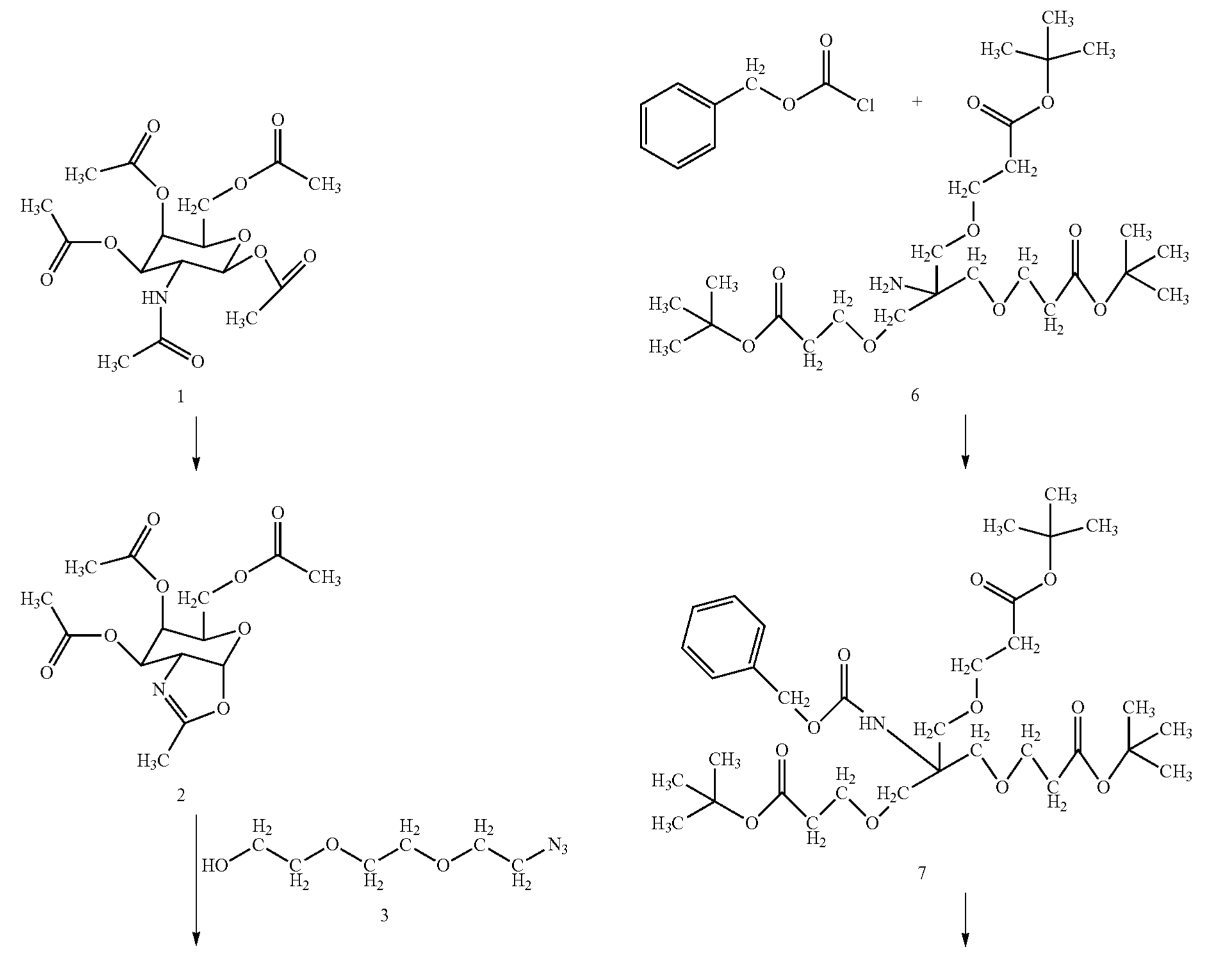

1

6

2

3

7

-continued
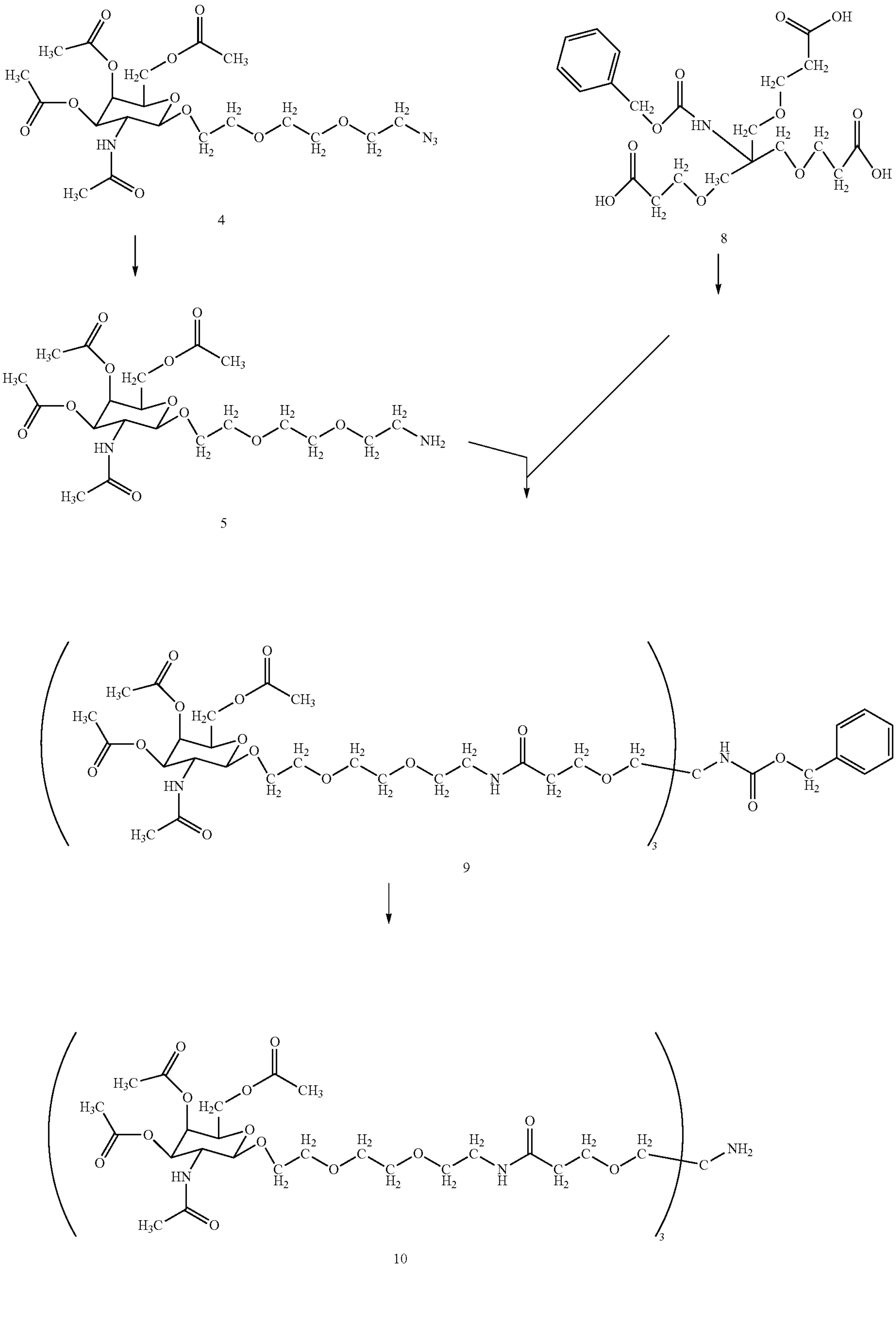
4 8 5 9 10

Scheme 7
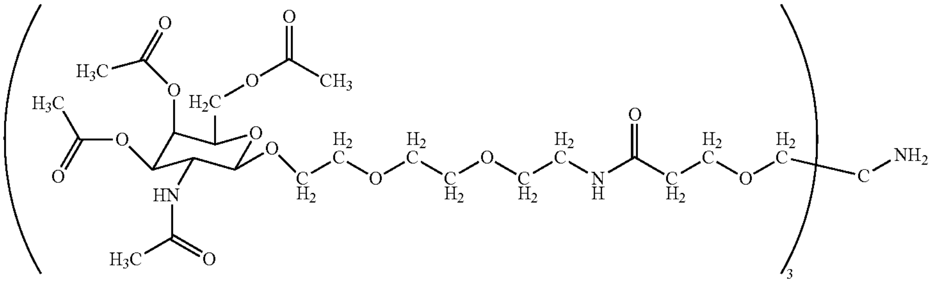
10
+
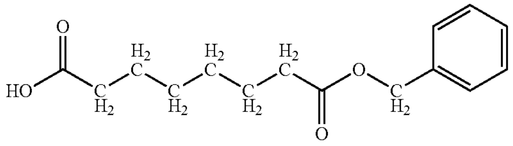
13
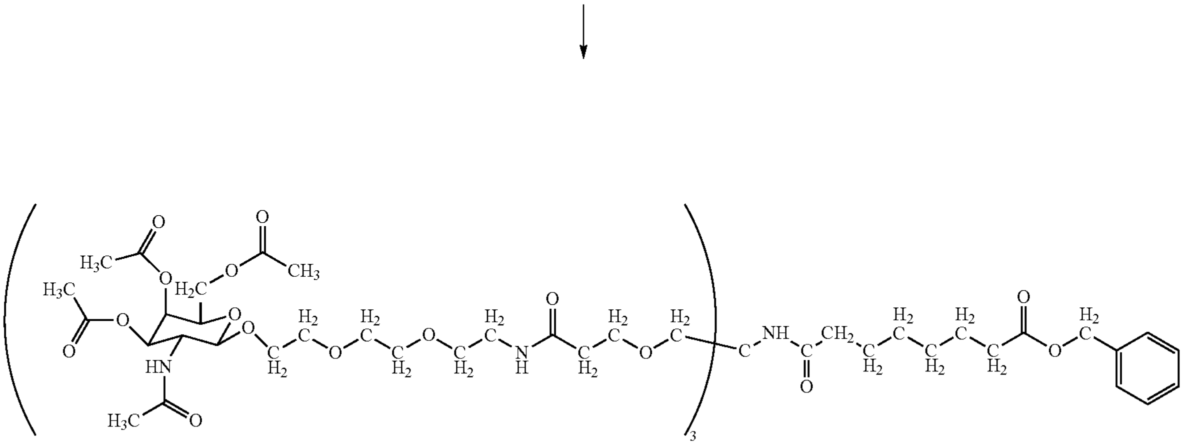
14
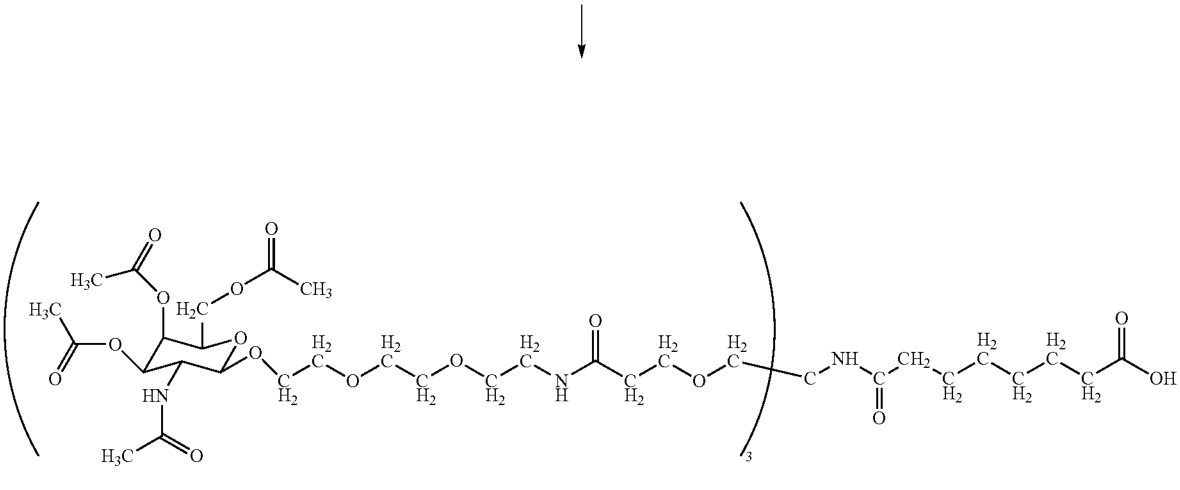
15

Scheme 8
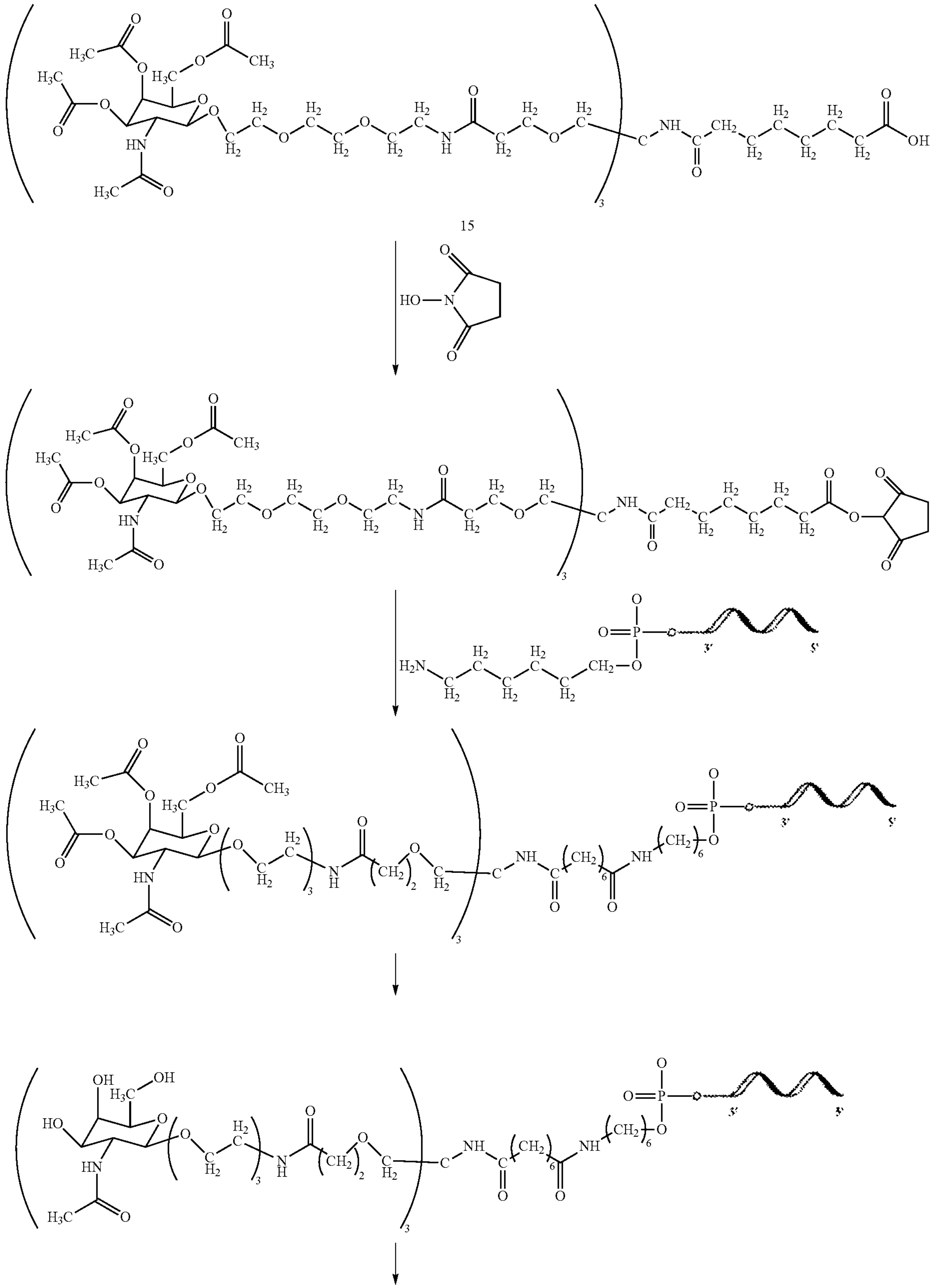

-continued
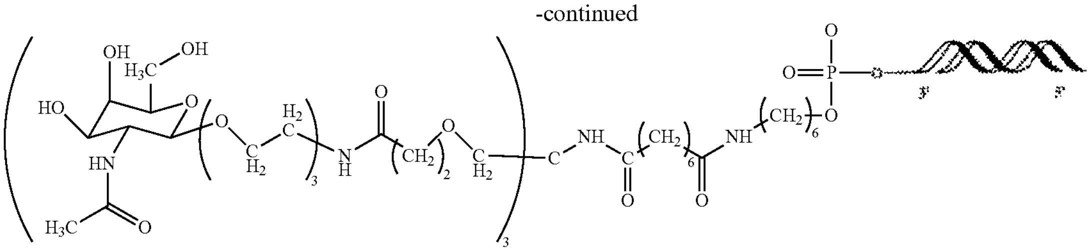
Scheme 9
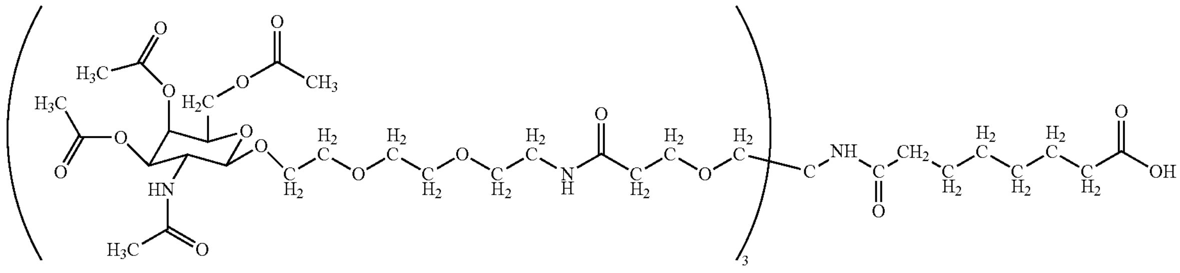
15
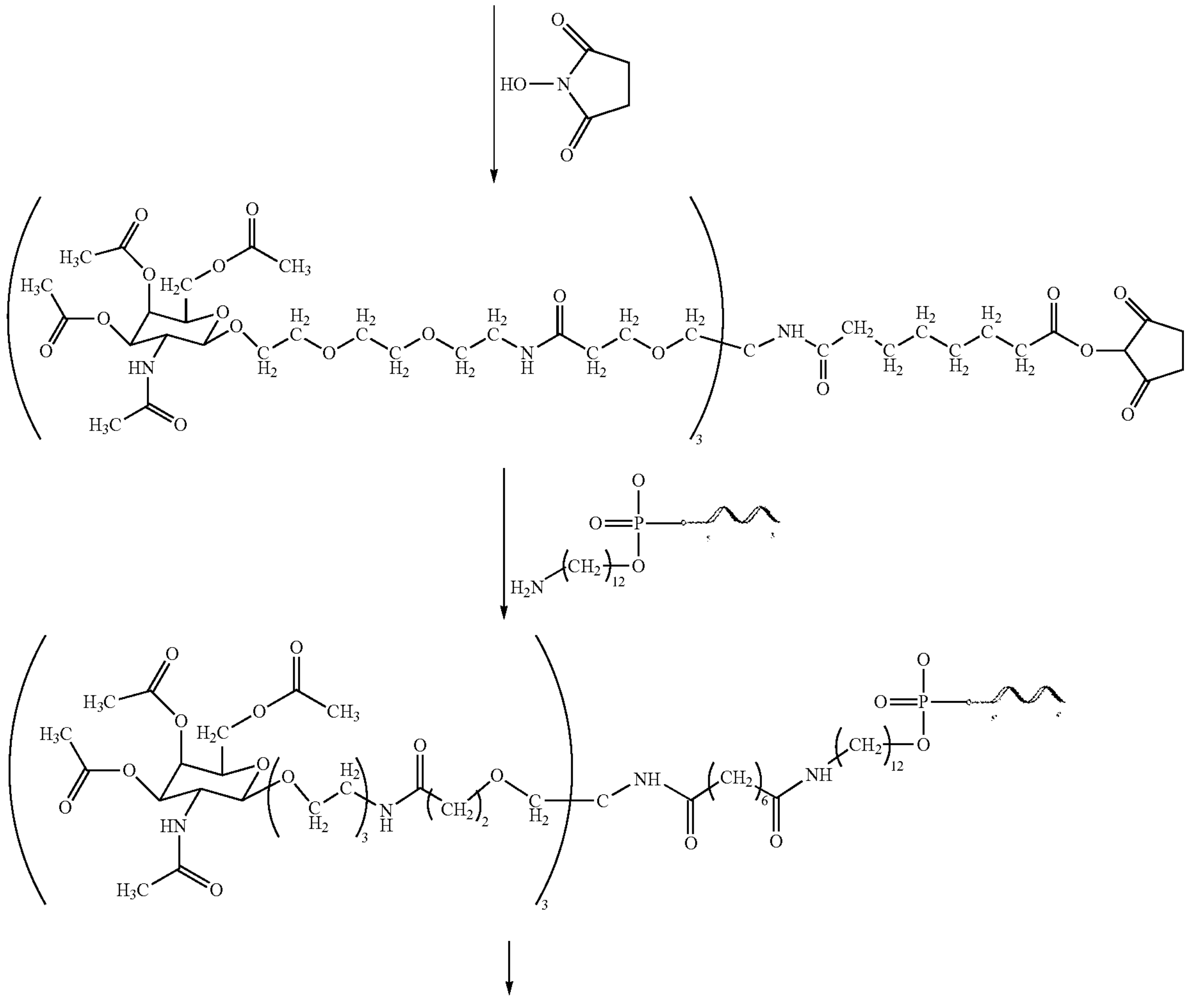

-continued

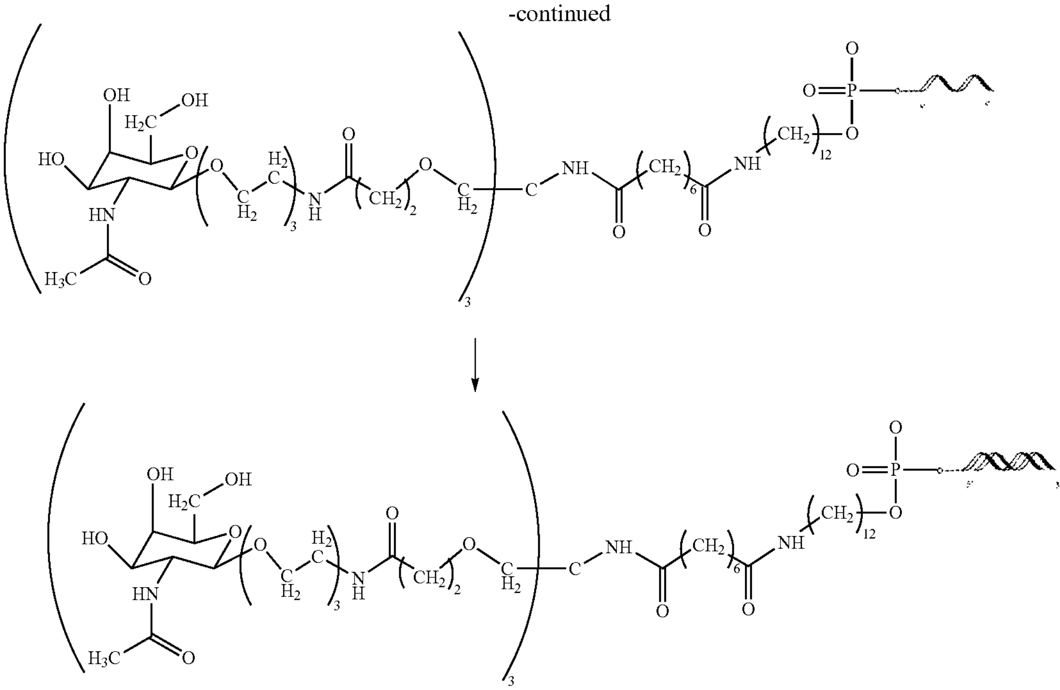

Example 5: Duplex Annealing

To generate the desired siRNA duplex, the two complementary strands were annealed by combining equimolar aqueous solutions of both strands. The mixtures were placed into a water bath at 70° C. for 5 minutes and subsequently allowed to cool to ambient temperature within 2 h. The duplexes were lyophilized for 2 days and stored at −20° C.

The duplexes were analyzed by analytical SEC HPLC on Superdex™ 75 Increase 5/150 GL column 5×153-158 mm (Cytiva) on a Dionex Ultimate 3000 (Thermo Fisher Scientific) HPLC system. Mobile phase consisted of 1×PBS containing 10% acetonitrile. An isocratic gradient was run in 10 min at a flow rate of 1.5 mL/min at room temperature. UV traces at 260 and 280 nm were recorded. Water (LC-MS grade) was purchased from Sigma-Aldrich and Phosphate-buffered saline (PBS; 10×, pH 7.4) was purchased from GIBCO (Thermo Fisher Scientific).

Example 6: Alternative Synthesis Route for the Conjugate Building Block Trigalnac Tether2

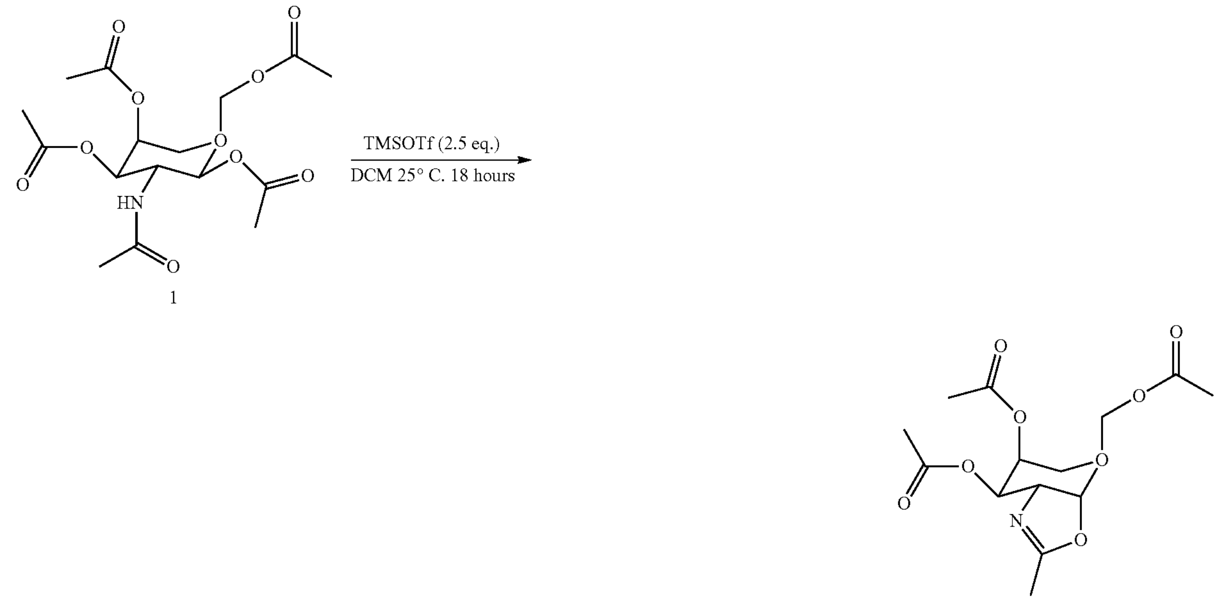

1

83% yield

2

-continued
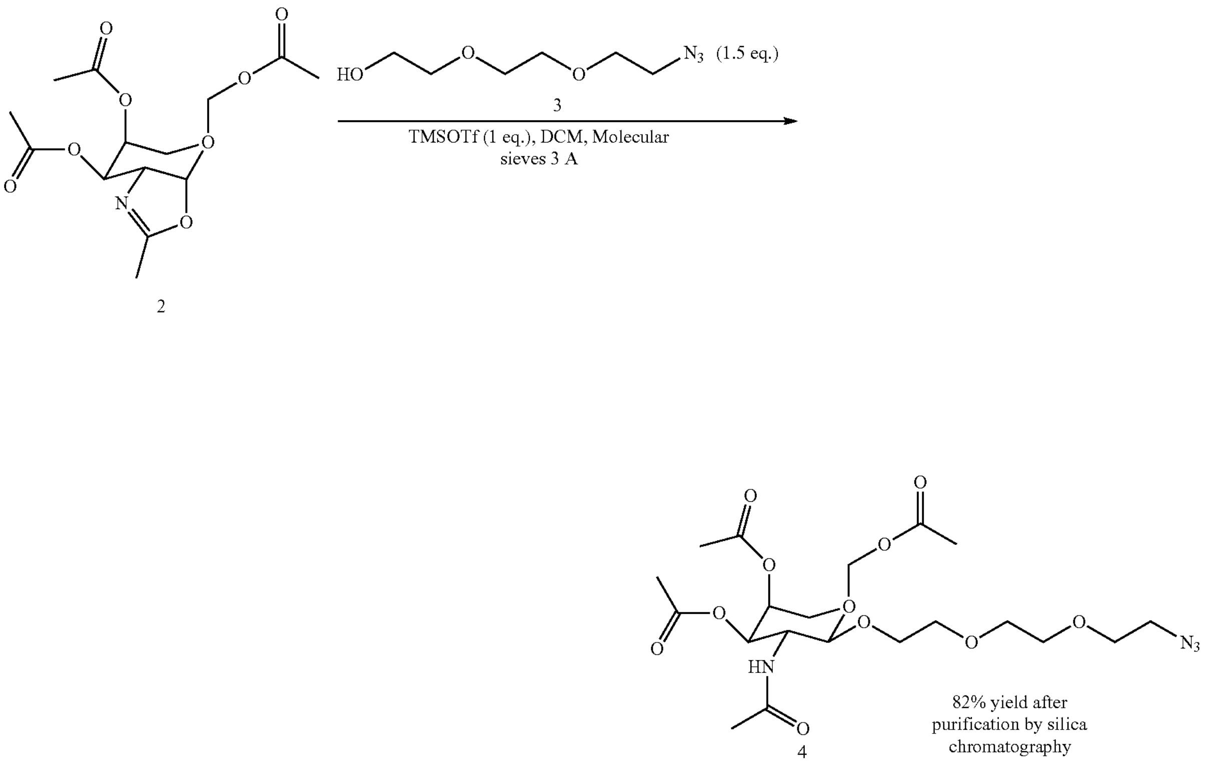
2 3 4
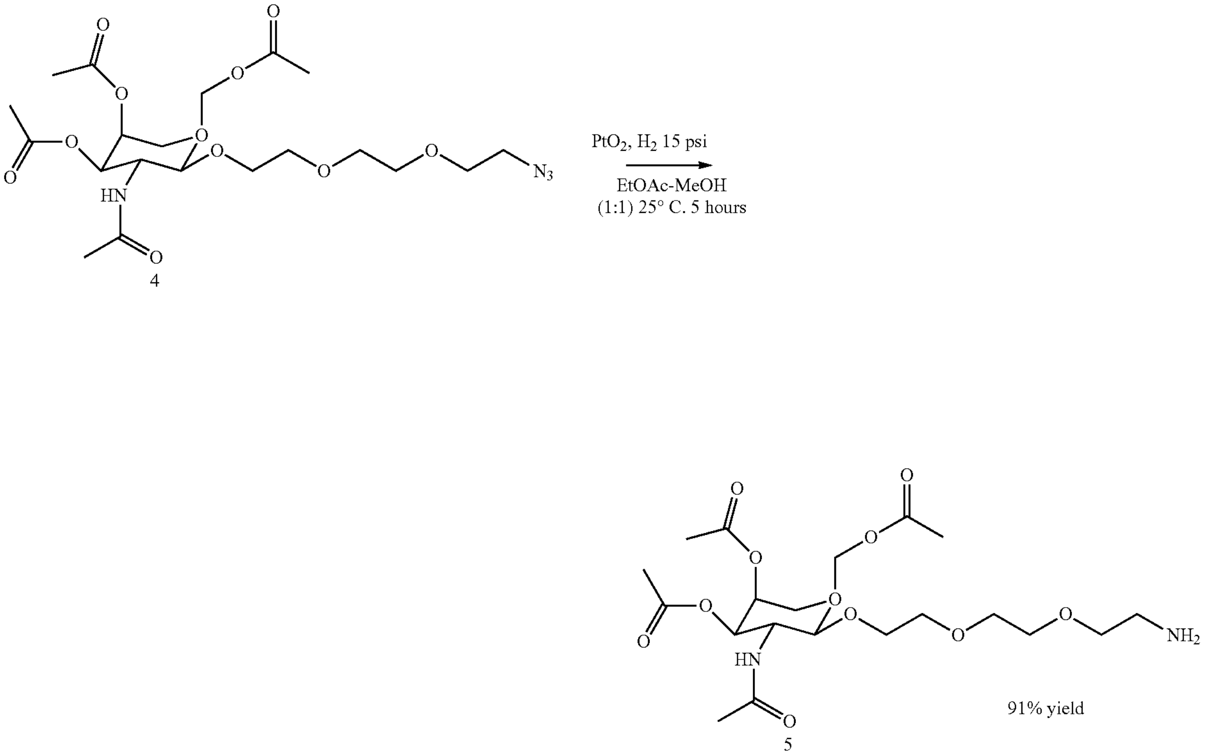
4 5

-continued
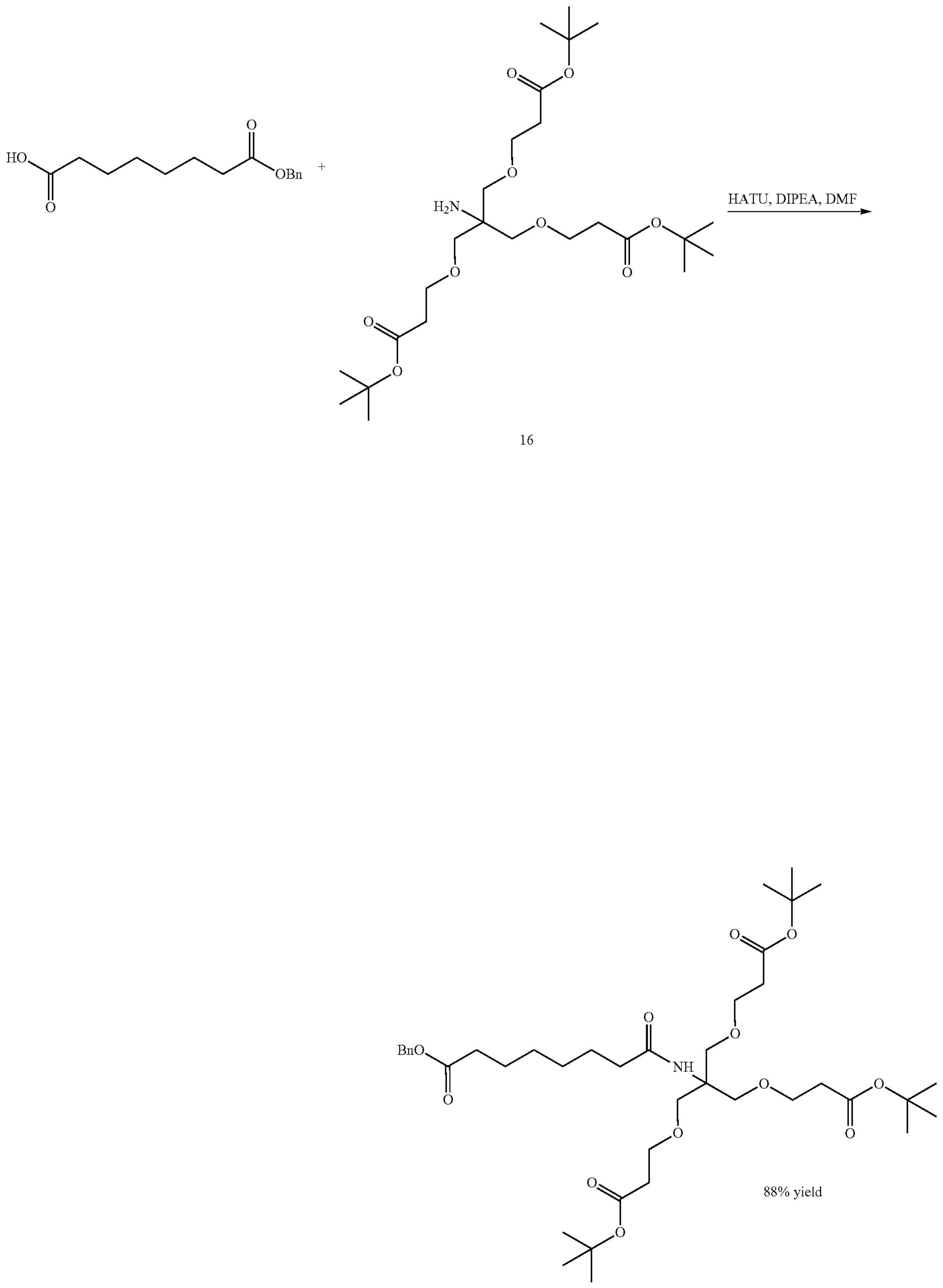
16
17

-continued
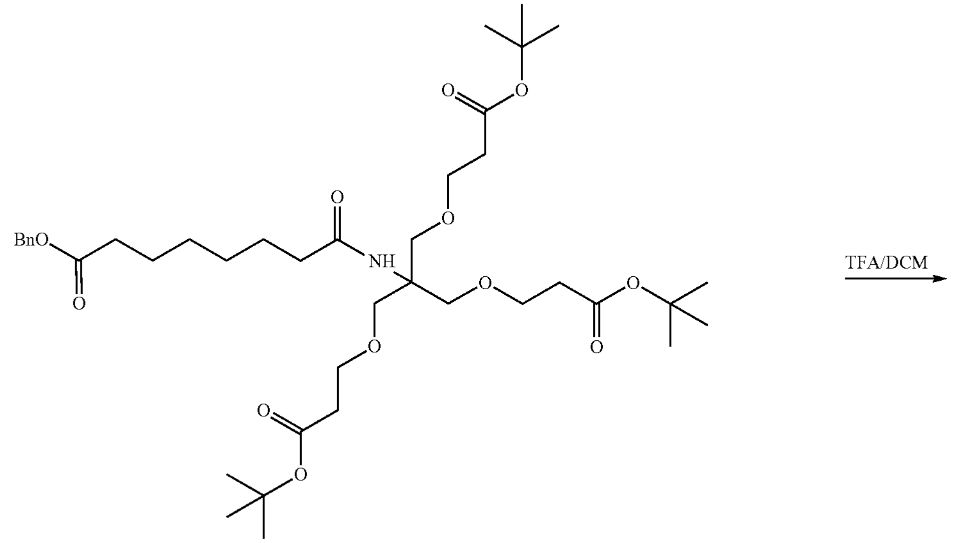
17
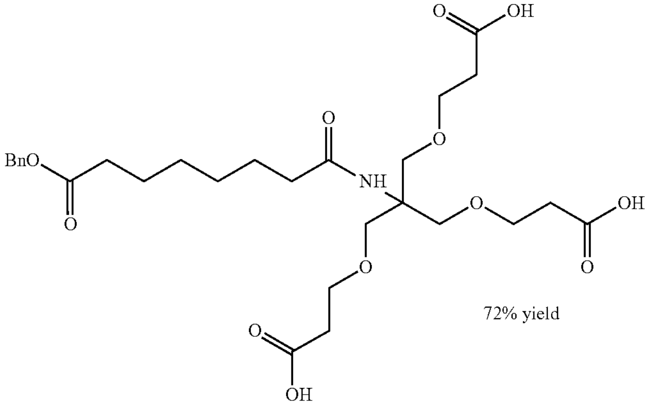
18
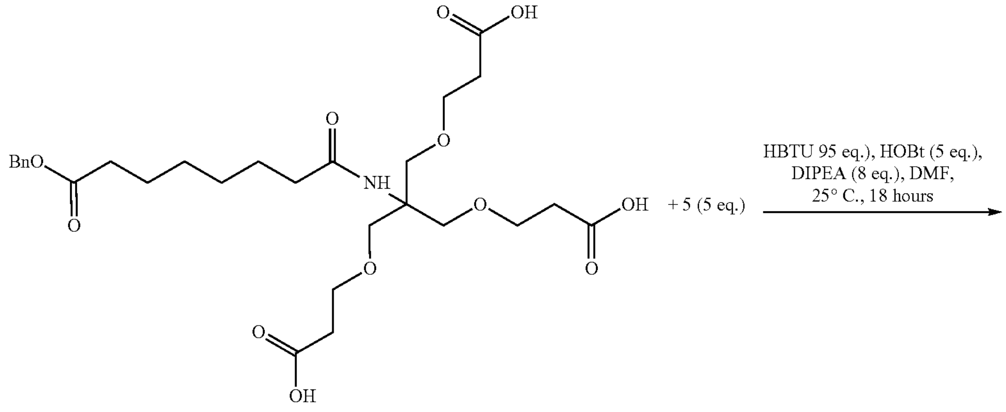
18

-continued
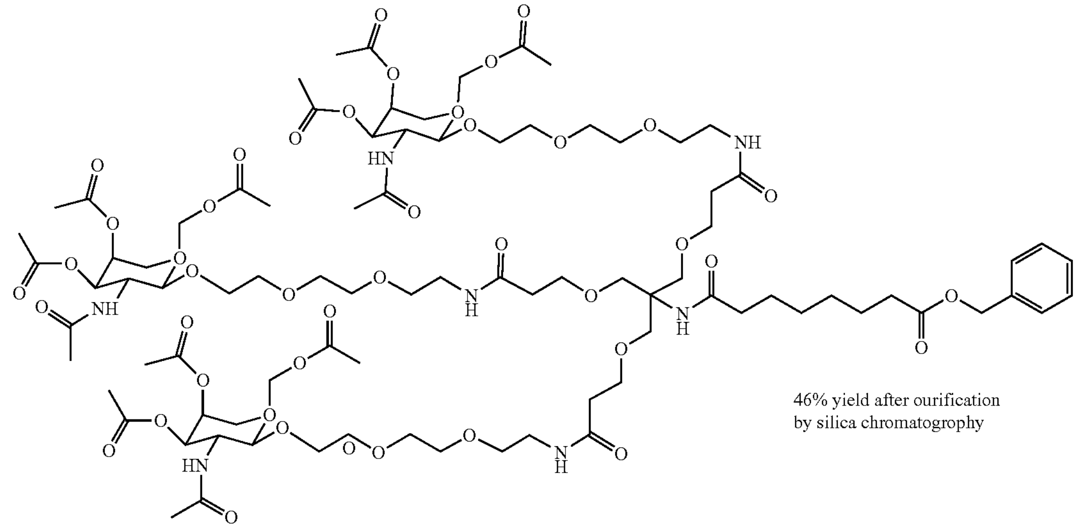
14
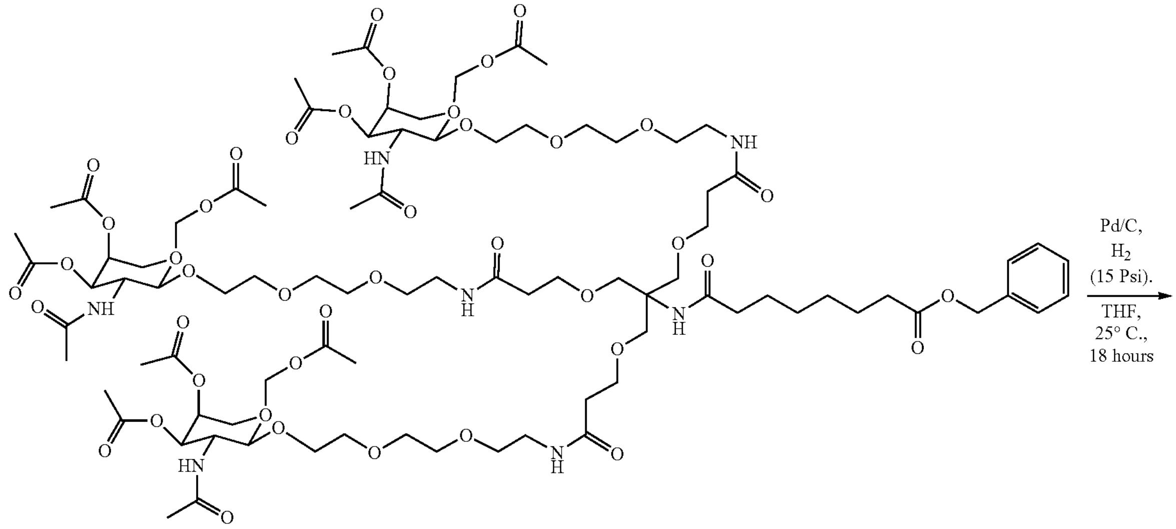
14

-continued
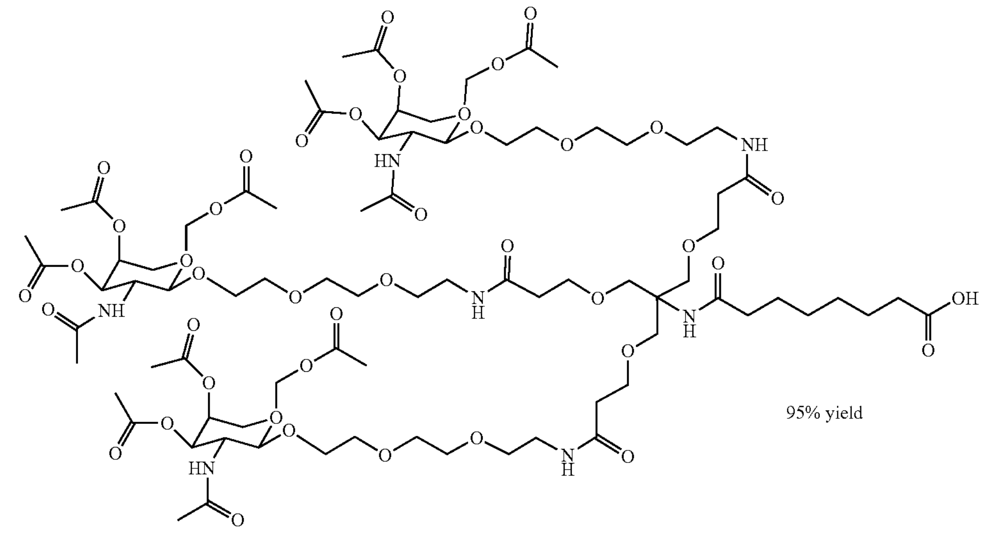
15
Conjugation of Tether 2 to a siRNA Strand: TriGalNAc Tether 2 (GalNAc-T2) Conjugation at 5'-End or 3'-End Conjugation Conditions
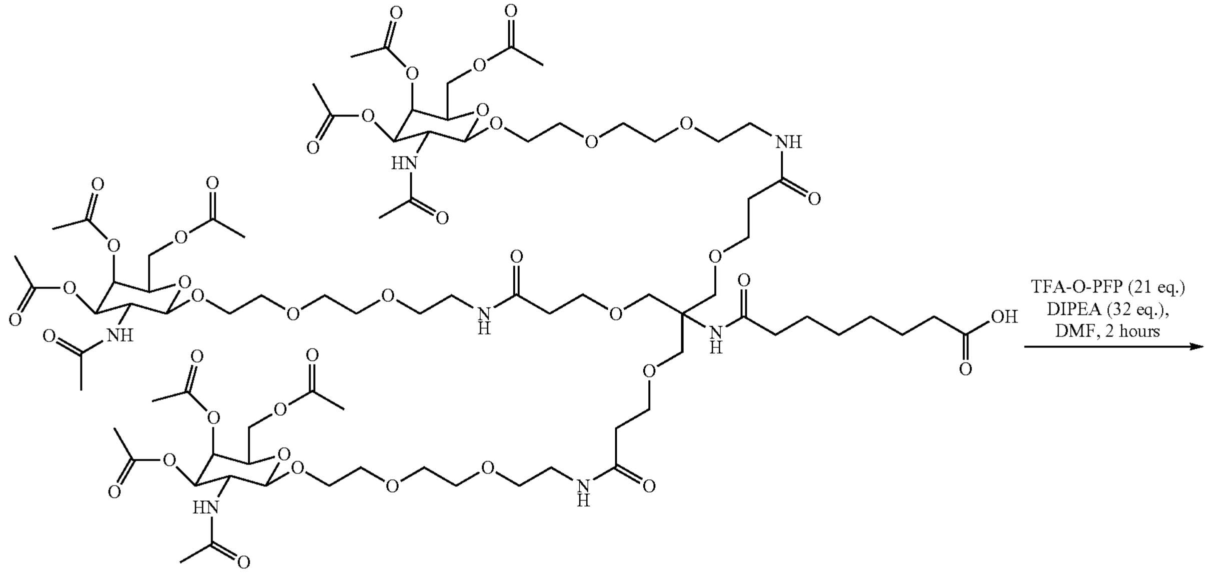
15

-continued

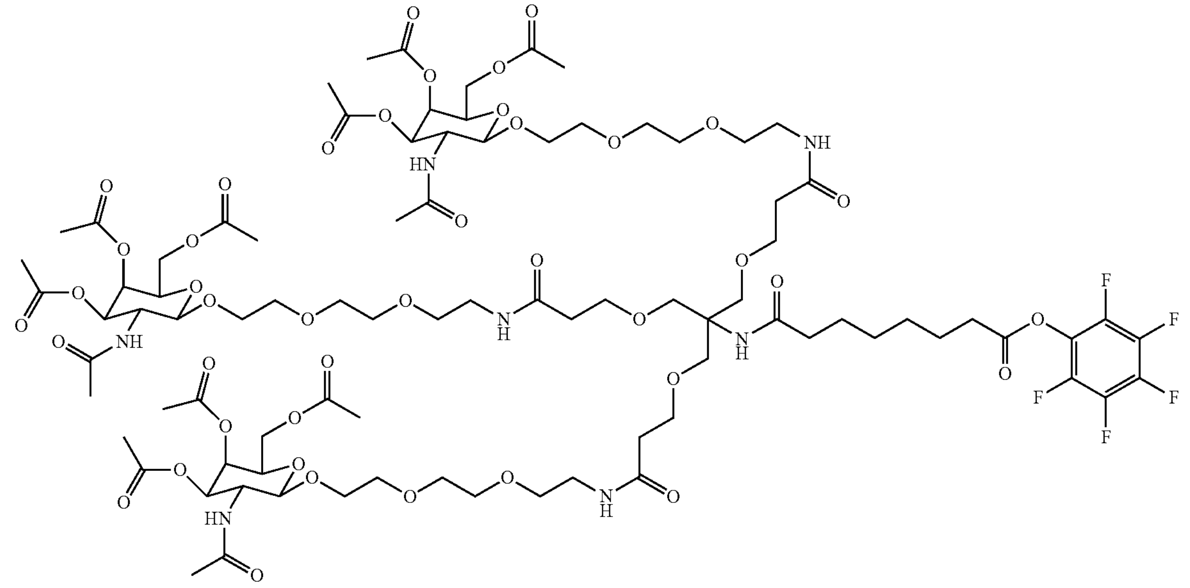

19
Pre-activated intermediate

Pre-activation: To a solution of compound 15 (16 umol, 4 eq.) in DMF (160 μL) was added TFA-O-PFP (15 μl, 21 eq.) followed by DIPEA (23 μl, 32 eq.) at 25° C. The tube was shaken for 2 h at 25° C. The reaction was quenched with $H_2O$ (10 L).

Coupling: The resulting mixture was diluted with DMF (400 μl), followed by addition of oligo-amine solution (4.0 μmol in 10×PBS, pH 7.4, 500 L; final oligo concentration in organic and aqueous solution: 4 μmol/ml=4 mM). The tube was shaken at 25° C. for 16 h and the reaction was analysed by LCMS. The resulting mixture was treated with 28% $NH_4OH$ (4.5 ml) and shaken for 2 h at 25° C. The mixture was analysed by LCMS, concentrated, and purified by IP-RP HPLC to produce the oligonucleotides conjugated to tether 2 GalNAc.

5'-GAlNAc-T2 conjugates

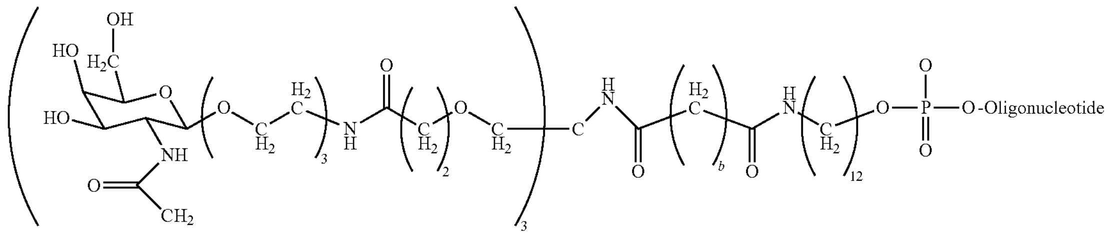

3'-GAlNAc-T2 conjugates

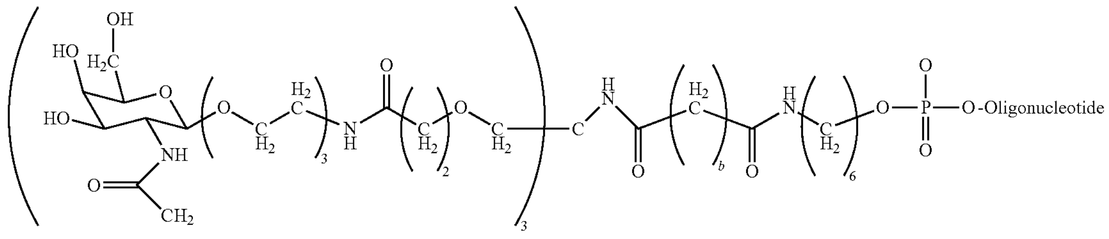

Example 7: Solid Phase Synthesis Method: Scale ≤1 μMol

Syntheses of siRNA sense and antisense strands were performed on a MerMade192X synthesiser with commercially available solid supports made of controlled pore glass with universal linker (Universal CPG, with a loading of 40 μmol/g; LGC Biosearch or Glen

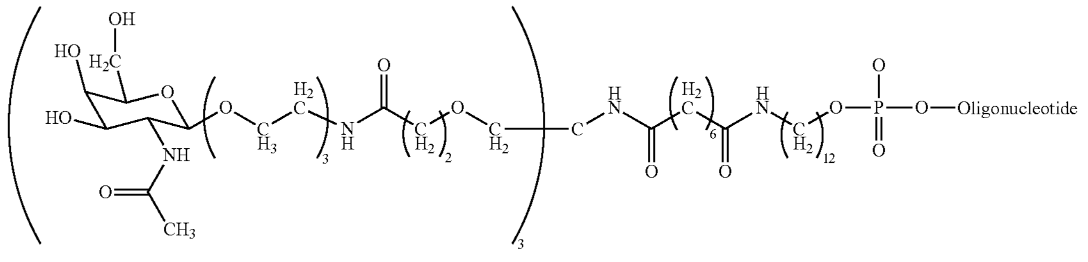

Research).

RNA phosphoramidites were purchased from ChemGenes or Hongene.

The 2'-O-Methyl phosphoramidites used were the following: 5'-(4,4'-dimethoxytrityl)-N-benzoyl-adenosine 2'-O-methyl-3'-[(2-cyanoethyl)-(N,N-diisopropyl)]-phosphoramidite, 5'-(4,4'-dimethoxytrityl)-N-acetyl-cytidine 2'-O-methyl-3'-[(2-cyanoethyl)-(N,N-diisopropyl)]-phosphoramidite, 5'-(4,4'-dimethoxytrityl)-N-isobutyryl-guanosine 2'-O-methyl-3'-[(2-cyanoethyl)-(N,N-diisopropyl)]-phosphoramidite, 5'-(4,4'-dimethoxytrityl)-uridine 2'-O-methyl-3'-[(2-cyanoethyl)-(N,N-diisopropyl)]-phosphoramidite.

The 2'-F phosphoramidites used were the following: 5'-dimethoxytrityl-N-benzoyl-deoxyadenosine 2'-fluoro-3'-[(2-cyanoethyl)-(N,N-diisopropyl)]-phosphoramidite, 5'-dimethoxytrityl-N-acetyl-deoxycytidine 2'-fluoro-3'-[(2-cyanoethyl)-(N,N-diisopropyl)]-phosphoramidite, 5'-dimethoxytrityl-N-isobutyryl-deoxyguanosine 2'-fluoro-3'-[(2-cyanoethyl)-(N,N-diisopropyl)]-phosphoramidite and 5'-dimethoxytrityl-deoxyuridine 2'-fluoro-3'-[(2-cyanoethyl)-(N,N-diisopropyl)]-phosphoramidite.

All phosphoramidites were dissolved in anhydrous acetonitrile (Honeywell Research Chemicals) at a concentration of 0.05M, except 2'-O-methyl-uridine phosphoramidite which was dissolved in DMF/MeCN (1:4, v/v). Iodine at 0.02M in acetonitrile/Pyridine/H2O (DNAchem) was used as oxidizing reagent. Thiolation for phosphorothioate linkages was performed with 0.2 M PADS (TCI) in acetonitrile/pyridine 1:1 v/v. 5-Ethyl thiotetrazole (ETT), 0.25M mM in acetonitrile was used as activator solution.

Inverted abasic phosphoramidite, 3-O-Dimethoxytrityl-2-deoxyribose-5-[(2-cyanoethyl)-(N, N-diisopropyl)]-phosphoramidite were purchased from Chemgenes (ANP-1422) or Hongene (OP-040).

At each cycle, the DMT was removed by deblock solution, 3% TCA in DCM (DNAchem).

The coupling time was 180 seconds. The oxidizer contact time was set to 80 seconds and thiolation time was 2*100 seconds.

At the end of the synthesis, the oligonucleotides were cleaved from the solid support using a $NH_4OH$:EtOH solution 4:1 (v/v) for 20 hours at 45° C. (TCI). The solid support was then filtered off, the filter was thoroughly washed with $H_2O$ and the volume of the combined solution was reduced by evaporation under reduced pressure.

Oligonucleotide were treated to form the sodium salt by ultracentrifugation using Amicon Ultra-2 Centrifugal Filter Unit; PBS buffer (10×, Teknova, pH 7.4, Sterile) or by EtOH precipitation from 1M sodium acetate.

The single strands identity were assessed by MS ESI- and then, were annealed in water to form the final duplex siRNA and duplex purity were assessed by size exclusion chromatography.

Example 8: Solid Phase Synthesis Method: Scale ≥5 μmol

Syntheses of siRNA sense and antisense strands were performed on a MerMade12 synthesiser with commercially available solid supports made of controlled pore glass with universal linker (Universal CPG, with a loading of 40 mol/g; LGC Biosearch or Glen Research) at 5 μmol scale. Sense strand destined to 3 conjugation were sytnthesised at 12 μmol on 3-PT-Amino-Modifier C6 CPG 500 Å solid support with a loading of 86 μmol/g (LGC).

RNA phosphoramidites were purchased from ChemGenes or Hongene.

The 2'-O-Methyl phosphoramidites used were the following: 5'-(4,4'-dimethoxytrityl)-N-benzoyl-adenosine 2'-O-methyl-3'-[(2-cyanoethyl)-(N,N-diisopropyl)]-phosphoramidite, 5'-(4,4'-dimethoxytrityl)-N-acetyl-cytidine 2'-O-methyl-3'-[(2-cyanoethyl)-(N,N-diisopropyl)]-phosphoramidite, 5'-(4,4'-dimethoxytrityl)-N-isobutyryl-guanosine 2'-O-methyl-3'-[(2-cyanoethyl)-(N,N-diisopropyl)]-phosphoramidite, 5'-(4,4'-dimethoxytrityl)-uridine 2'-O-methyl-3'-[(2-cyanoethyl)-(N,N-diisopropyl)]-phosphoramidite.

The 2'-F phosphoramidites used were the following: 5'-dimethoxytrityl-N-benzoyl-deoxyadenosine 2'-fluoro-3'-[(2-cyanoethyl)-(N,N-diisopropyl)]-phosphoramidite, 5'-dimethoxytrityl-N-acetyl-deoxycytidine 2'-fluoro-3'-[(2-cyanoethyl)-(N,N-diisopropyl)]-phosphoramidite, 5'-dimethoxytrityl-N-isobutyryl-deoxyguanosine 2'-fluoro-3'-[(2-cyanoethyl)-(N,N-diisopropyl)]-phosphoramidite and 5'-dimethoxytrityl-deoxyuridine 2'-fluoro-3'-[(2-cyano-ethyl)-(N,N-diisopropyl)]-phosphoramidite.

Inverted abasic phosphoramidite, 3-O-Dimethoxytrityl-2-deoxyribose-5-[(2-cyanoethyl)-(N, N-diisopropyl)]-phosphoramidite were purchased from Chemgenes (ANP-1422) or Hongene (OP-040).

All phosphoramidites were dissolved in anhydrous acetonitrile (Honeywell Research Chemicals) at a concentration of 0.05M, except 2'-O-methyl-uridine phosphoramidite which was dissolved in DMF/MeCN (1:4, v/v).

Iodine at 0.02M in acetonitrile/Pyridine/$H_2O$ (DNAchem) was used as oxidizing reagent. Thiolation for phosphorothioate linkages was performed with 0.2 M PADS (TCI) in acetonitrile/pyridine 1:1 v/v. 5-Ethyl thiotetrazole (ETT), 0.25M mM in acetonitrile was used as activator solution.

At each cycle, the DMT was removed by deblock solution, 3% TCA in DCM (DNAchem).

For strands synthesised on universal CPG the coupling was performed with 8 eq. of amidite for 130 seconds. The oxidation time was 47 seconds, the thiolation time was 210 seconds.

For strands synthesised on 3'-PT-Amino-Modifier C6 CPG the coupling was performed with 8 eq. of amidite for 2*150 seconds. The oxidation time was 47 seconds, the thiolation time was 250 seconds.

At the end of the synthesis, the oligonucleotides were cleaved from the solid support using a $NH_4OH$:EtOH solution 4:1 (v/v) for 20 hours at 45° C. (TCI). The solid support was then filtered off, the filter was thoroughly washed with $H_2O$ and the volume of the combined solution was reduced by evaporation under reduced pressure.

Oligonucleotide were treated to form the sodium salt by EtOH precipitation from 1M sodium acetate.

The single strand oligonucleotides were purified by IP-RP HPLC on Xbridge BEH C18 5 μm, 130 Å, 19×150 mm (Waters) column with an increasing gradient of B in A. Mobile phase A: 240 mM HFIP, 7 mM TEA and 5% methanol in water; mobile phase B: 240 mM HFIP, 7 mM TEA in methanol.

The single strands purity and identity were assessed by UPLC/MS ESI- on Xbridge BEH C18 2.5 μm, 3×50 mm (Waters) column with an increasing gradient of B in A. Mobile phase A: 100 mM HFIP, 5 mM TEA in water; mobile phase B: 20% mobile phase A: 80% Acetonitrile (v/v).

Sense strands were conjugated as per protocol provided in any of Examples 2, 4, 6.

Sense and Antisense strands were then annealed in water to form the final duplex siRNA and duplex purity were assessed by size exclusion chromatography.

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

Example 9: B4GALT1 Pharmacology Study

ETX in-house computational biology analysis identified B4GALT1, encoding beta-1,4-galactosyltransferase 1, as a gene associated with Type 2 Diabetes (T2D) (see Example 1). Here we establish B4GALT1 as a potential therapeutic target for T2D. In-silico-designed GalNAc-siRNAs targeting mouse hepatic B4GALT1 were synthesized and tested to access the plausibility of the hypothesis that a significant knockdown of hepatic B4GALT1 mRNA lowers the plasma levels of LDL-c, fibrinogen, and fasting glucose.

In Vitro Dose-Response Assay to Select Potent Molecules

In vitro dose-response assay measuring the gene knockdown in primary mouse hepatocytes (PMHs) was performed to test 20 GalNAc-siRNAs targeting hepatic B4GALT1. Primary C57BL/6 mouse hepatocytes (PMHs) were isolated fresh by two-step collagenase liver perfusion. Cells were maintained in DMEM (Gibco-11995-092) supplemented with FBS, Penicillin/Streptomycin, HEPES and L-glutamine. Cells were cultured at 37° C. in an atmosphere with 5% $CO_2$ in a humidified incubator. Within 2 hours post isolation, PMHs were seeded at a density of 36,000 cells/well in regular 96-well tissue culture plates. Dose response analysis in PMHs was done by direct incubation of cells in a gymnotic free uptake setting with final GalNAc-siRNA concentrations of 1000, 500, 250, 125, 62.5, 31.3, 15.6, 7.8, 3.9, 1.95 nM. In control wells, cells were incubated without GalNAc-siRNA. After 48 hr incubation, cells were harvested for RNA extraction. Total RNA was extracted using RNeasy Kit following the manufacturer's instructions (Qiagen, Shanghai, China). After reverse transcription, real-time quantitative PCR was performed using an ABI Prism 7900HT to detect the relative abundance of B4GALTJ mRNA normalized to the housekeeping gene GAPDH. The expression of the target gene in each test sample was determined by relative quantitation using the comparative Ct (ΔΔCt) method. This method measures the Ct differences (ΔCt) between target gene and housekeeping gene. The formula is as follows: ΔCt=average Ct of B4GALT1-average Ct of GAPDH, ΔΔCt=ΔCt (sample)−average ΔCt (untreated control), relative expression of target gene mRNA=$2^{-\Delta\Delta ct}$. Based on the results of in vitro free uptake experiment, GalNAc-siRNAs displaying good activity were selected for $EC_{50}$ determination using a 10-point concentration curve (FIG. 12).

In Vivo Pharmacology with Four Selected GalNAc-siRNAs

The pharmacodynamic activity of four selected B4GALT1 GalNAc-siRNAs was measured in vivo. Twelve C57BL/6 male mice were allocated for each of GalNAc-siRNAs, ETXM619, ETXM624, ETXM628 and ETXM633. 5 mice were allocated as no-treatment control group. Mice were subcutaneously dosed with ETXMs (10 mg/kg) on day 0, defined as the day mice were first dosed, day 3 and day 7. 3 mice in each treatment group were sacrificed on day 3, day 7, day 10 and day 14. Upon termination, liver tissues and plasma samples were harvested for further analysis. Day 3 samples were used to evaluate the single dose effect of ETXMs given on day 0. Day 7 samples represent the repeat dose effect of ETXMs given on day 0 and day3. Likewise, day 10 and day 14 samples represent the repeat dose effect of ETXMs given on day 0, day 3 and day 7. 5 mice allocated as the control group were sacrificed on day 14.

B4GALT1 Gene Knockdown in Mouse Liver

Harvested liver samples were used to measure the B4GALT1 mRNA knockdown level by RT-qPCR. Upon collection, each tissue was treated with RNAlater and stored at 4° C. overnight then at −80° C. until the further analysis. Liver tissues were homogenized with TRIZOL for RNA extraction. RNA samples, adjusted to 400 ng/L, were reverse transcribed to cDNA using FastKing RT Kit, manufactured by TIANGEN. After gDNA removal procedure, purified cDNA samples were used for RT-qPCR. RT-qPCR method and the relative mRNA expression calculations are as described above. FIG. 13 shows that all test articles exhibit >50% gene knockdown efficiency at day 3, 7, 10 and 14.

Terminal Plasma Collection and Measurement of Plasma Biomarkers Using Biochemical Analyser The terminal plasma samples were collected via submandibular vein after 4-5 hour fasting. Blood samples were collected in heparin sodium coated tubes then centrifuged at 7,000 g at 4° C. for 10 min to obtain plasma samples. The plasma samples were used for the measurements of AST, ALT, albumin, ALP, BUN, CREA, TBIL, glucose, total cholesterol, LDL-c, HDL-c, triglycerides and NEFA (free fatty acids) by a biochemical analyser.

Measurement of Plasma Insulin and Fibrinogen Levels Using ELISA Kits

Blood samples were collected in $K_2EDTA$ coated tubes then centrifuged at 7,000 g at 4° C. for 10 minutes to obtain plasma samples. The plasma insulin level was measured using Mouse Insulin ELISA kit (Mercodia, 10-1247-01) according to the manufacturer's protocol. The fibrinogen plasma level was measured using Mouse Fibrinogen Antigen Assay kit (Innovative Research, IMSFBGKTT).

B4GALT1 Gene Silence Effect in Biomarker Modulation

The means of the untreated control group (n=5) and the day-14 treatment group comprising groups administered with ETXM619, ETXM624, ETXM628 or ETXM633 subcutaneously at day 0, day 3 and day7 (n=3 per group, n=12 total) were tested for equality under the null hypothesis via a two-tailed t-test. Statistically significant differences in the means of efficacy biomarker readouts were detected with an 18.8% decrease in LDL-C ($p<0.05$); a 21.0% decrease in fasting glucose ($p<0.05$); and a 29.6% decrease in fibrinogen ($p<0.01$) (FIG. 14).

SEQUENCE LISTING (623 sequences)

SEQ ID NO: 1 - DNA, 63718 bp, Homo sapiens
  source 1..63718: mol_type = genomic DNA
gaggcatgaagaaataattgtgcatgactgaggactttccagacctcccctttccttccaccagttacttactaatctcagaatccaccccccaaaatttttctgataaaaacactaccttaaagccagcccagggagacttgagccagcccagggagacctaaagtcaccacagggagatttcagctggactcttctatctccttgttggcctacctgcagtacaaagcttttcttttctcaaaaaccaggtgtcacagtattggtttctagaacattgggcagtgagtgcttttgcgctttggtcggtaacacctggatctgatttagacaatactttggacctgaagtcttaattagttgaacttttgggggattttaagaagacactaatgtattttacctgtgagaagaatctaaataatctgtggccattgggcaaactactgtggaataaaggtgcctgacaattctttgtccctcctcccatcaagaggtggagtcagccaggtgaaatggctcatgctggtaatctcagcactttgggaggccaaagcaggaagactgcgtgagctcaggagttcgagactagcctgagcaatatcgcaacatctcatctctactaaaaattttaaaattagctggacgtggaggcgcatcccggtagtcccagctactcgggaggctgaggcaggagaatcacttgagcccaggagtttgacgttatagtgacctatgatcacaccactgcactacaggctggttgataaaggaagatcctgtctaaaaaaaaaagtaaaaacaagaggccgagccagttttattccccttgaatctggcctgccctataaacttgttttaagcaaaagaatgctttagaagtgatgctaaggctgggctttcagggatctccatcttctgtatttttgaaatgctcctttttggaatgcttcctctagtttgtgaggaaacccaagcagccacatggagagtcctttgtggagagatccaagtggagaatgaaggccccatgacccaacccattctgagtttccagcccccagacagccccaactgccattcacatgagtgaagccattttggaacttccaactgtgccagtgcctcagctgacaccatgtgaggcaaagctgcccagccaactgcaaaactgcgagaaattgttgcttcaaaacagtaagttttggggtaggtgttacgctgcaatagatgactgaaataactgtctaccatgtgccgggcactatttgatgcccttctgatccatgagggtaaaaacagaaatgtaacctggcaggtgcagaagagggcgccataggagggcagaggaaggccagctgcagggagaagcagggagctggtgattctgggcagatgagcacatggatgggccaacggccaagcccccatgccagcttttggccaatcagcactgcaacttcctcctgcatttgtctcgccggatgggattaatttttcacctgacgaagtagagagtggaaaagagctggagacagtggggagaaaggttgcctgggtctgtctcactagcaccagttaatgtctggactgctggacaatgttgtcccaaaggtttctgggccatctgtattatttgtaattgactgcttctaggtgcctgtggatcaggggcagctgagactagtgctcaggcctcagtggactctgcaagttcctgagggataggcaatcagcaagtgttgttccttttcctcgatttctggccacgtgtgtcctgggacaggtctgtgattcttaataacccccgcagtcctgtctcctggctatcatctataccaatggaagacacatccccatttccccctccacttaattttcagttgcaggactaatctgacccaccctcactcattggccaggccgactttacccctagacacaggatgctggggtcagcttcacctttaccaactccttggagaactccactttacgttctaaactaagttagcaataatttttcccttctctccttcccacatcattaagatgatcacagtatttaaaaagtattttaacaaatatcggccgggcacggtggctcacaactgtaatcccagcactttgggaggccgaggcaggcagatcacgaggtcaaaagattgagaccattctggataacacggtgaaaccccatctctactaaaaatacaaacaaattagccgggcatggtggcaggcacctgtagtcccagctacttgggaggctgaggcaggagaatggcgtgaacccaggaggcagagcttgcagtgagccaagatcacgccactgcactccagcctgggtgacagagtgagactccgtctcaaaaaaaaaaaaaaaaaaatctaggggctgaagatacagtagtgaacaagagagaaatttcctgttctcatgaagctgattttctaatgagggaggcaagacaacagaaaataaatgcataatgttgggtagttgatatccactctgaaaaaaatcaagcaggttaaggccgggcgcggtggctcacgcctgtaatcccagcactttgggaggccgaggcgggcggatcacctgaggtcaggagtttgaaaccagcctggccaacatggtgaaatccgtctctactaaaaacacaaaaaattagcccggcgtgatggcaggcacctgtaatcccagctactcaagaggctgaggcaggagaatcgcttgaacccgggaggcagaggttgcagtgaggtgagattgcaccattgcactccaacctgggggacaaaagcaagactttgtctcaaaaaaaaaaaaaaaaaaattcaagcagtttaagcagatttgggcaggaggccattctgcataaggtagtctgaaaaggtctctgtcataaggtgacatttaagagacctgaattgaatgaaatattggggacaagtgtttcaggctaaatgaacagcaagtacaaaggccctgaggcaggaagaaatatggcaagttcaaggaatagctatcaggctagtgtggctaaggcaggtccagcatggtagagtgacagatgtgggtggggagggaaataggaaccagattgaacagggtttctgtggatttggttctgaacaaaatggcatgatctgatttatgcttacaaagatttcctggatgctctgtggaaaacagactagggaggaggaatggaggaggtggaagcagggtgaccaattagtagctgccatataacccagggcaagatgatggtggcttgatcgaggatggttacatcagagttggctggtggtgaattttgatgttttgaaggtagcactgacaaagctggctgagggcttgcaaatggcattgagagcaagagaagcacatcaaggacaccttttagattctggggaactgaataaacaatagtatcactctctgagggaggtaagaacgggagtggtgtgtaaggagtaggttgctgagggcaagatgtattgtgtttgagatgccagtaaaataagcagttgaatctggaggtcagggaagagatctgggctggagacaaatcagtgatcagcatttggatattataaatcattccgaggcagtaagtgtagacacaaaagaacatcatggactatggctggggccttcagcaactggggaagaagtccagagaggagacagaaatggccagtgaagtgaggaagatcagaaggacctggtgtccaggaagtcaagtgaggaaagttgattctgtatgatcacaaccaaagtgtcaactcataagccttattttctcatctgtgaaatggacaccgtaacaccacctacttcatggcagatagtactggcacacagcaaactctcaaaataaggtagctactgttattccctgatggttggctgccagagccctcaacttccctatccacattactgacagcacctccatgagtctttctctggggtgaggtgtctctgctcactcagggcctgaggcctctgggtcaaatcgaggtcaagtggcttcagtgcctaagtctctcacccacacagccttcagcccttacttgcaaatcaacaaagggtaaacctgtagaaaacatgggtttcggagccagaattctgcctcttgccagctgtgggctcttaggaaagtttcttaatctgccggggccccactctacgacatggggagaactgctacttcatgggacagtgggtagcccagtgtagactgtaacgccggctgatctcctgcacgctggcctgggagttagaggcttcttgctgctctcctcttcaaagtatacaggactcccgccacacacacatctggaaccaagctggtctgagagccccttatagcccaggctacctgatggggaggcacagaagtggcaacccgtccactttctttgccgcaggaccccccgttaagcagcggggtccagccgggctgagttagggagggggtttcgaacgtgccactcctcgcccggcgtcgaagcccgtttcctgggtaacctttttctgcctctcttcctagcccaccaaggcccactggccagaacgccgccgcggccccaaaccactccagataaccacccgccagctgtcctctccgttctctccgccgccgcgctgcaggcccaggctcgcacccgagtcccttcgcaccccaggaagtggcgcggcctgtcgagggcagcgtggaggaggaagaggaggcgcggctcaacgcgaccgaagctccgccgcaaaggctcgggaggaagagggcggtgcgcggccaagcgtcggagctgcagtcatactccggggaccccacgacggcgccccgcccgctgcccaccctcccgaggccccgcccagcgcgcccatcccgccacgggctgccccgccttcccgccctcgtccagaaaaccccgcgcccggccccgcccccgccttcgccggggccccgcccctcccctctccgccggcgcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttggtaaggactcgggtcggcgccagtcggaggattgggacccccccggatttccccgacagggtcccccagacattccctcaggctggctcttctacgacagccagcctccctcttctggatcagagttttaaatcccagacagaggcttgggactggatgggagagaaggtttgcgaggtgggtccctggggagtcctgttggaggcgtggggccgggaccgcacagggaagtcccgaggcccctctagccccagaaccagagaaggccttggagacttccctgctgtggcccgaggctcaggaagttttggagtttgggtctgcttagggcttcgagcagccttgcactgagaactctggtagggacctcgagtaatccactcccttttggggactgacgtgaggctcccggtggggaaggagactgacctctcggttcacgtgtcttgccatagagccactctcctgagtgggtttttctcctgatcgtttgggccaagtgacttctctctgaacctcatatttctcttctgggataataaatggtcaccctttcaaggggttgttttggaagatattgtgaacaatggtaaataagggcttaattaatgagggtaagccctcagtaaattgtcactgtgtgttcatttcttcctctgtgtggatcgtgaccgagagcccttccccctagcctcctcctggtatgggtacccaaaacctaggtgagcagggatctctcccaggggcagagagcttgtgtactctgggtgttagagggctaaaatataaccagtcaacaccacgttgcccatttctggtacttccggtagcagcctgagtctcaattatcttgcccagatgatctgaactctgacctctagcctgtttcagcataggcagagagcttgagtaggtgagtttgcattcctcatagcagctggctgagcctagtctggacttctctttgacctgtaacctacaggcccacaggcccaaggcaaccacaggttgcttccagggttaccacacaggtggtttctcatttctaatgctaggttttagataattgttgtaagtgaggggccctggcaggcaggatgacatcctgccaataggagttttctgtcactttcccacagagccctggctactacatactcttgctcaatttcgccagtaattgcgtcaatgtgttcatatcaagtttgggaagaacatcttggaattggtcagacgtgaactgtggtaataatgggggcttgtttttttaagcagataattaaattcctttgcatttgatgattattctgggaagcagactagtcccataaaatgaaatggactctgccttgctgctaagtgtctgacttgagacatgctatcgagtttctcaaaatctcttccttgtgtaaaatgtggttgtcgatgattaccttacaggggtttttttaagactaaatgagatcgtgtacattaaatacaggcactcaggctgggcatggtggctcacgcctgtaatcctagcactttgggaggctgaggggagtggatcacttgaggttaggagtttgagaccagcctggccaatatggtgaaacaccatcccatctctacaaaaatacaaaaaagttagccaggggtggtggcatcgcagctactcaggaggccgaggcaggagaattgcttgaacctgggaggcagaggttgcagtgagtcaagattgtgccagtacactccagcctgggcgacgaagcaagactgtctaaaaaaaaaaaaaaaaaaaaaaatacgggcactcaatacaccgtataataataatatagtaataatatttgcttaggatctttaaaaagtttcattttttcagactcccacagaaatggctctgcacagcagagtgaagggggagagagactgagtctccaggccagaaaaaggccaggttttttgcttttgtttttagttgttgcctggatattgcacagaaagaaaaaataattagcaagttaaacaaaagtaccgcaaagttgattacattggtatttgagtatcacatcttctctcagaagcgtaagagacaaggtcgtgaccatacctctgcttagttttgttttgtaatggtgttgctagtgatcggcttgtcaccagttactggtgtttctaaatggactataattggctacttgaaaggacttcctgagaaagaacattttggaggacgaggagagagtgccttctctattttggctgctttcatgtgacatgcaagagaccatgacgtttaggctgctgctgaggcagccccagaaatgggggccgagaggtcttttcttcattttaatagggtctgtaggtttgggtggttaggtacagttctcagaatggaggttcctggctatgaggccttgagaaagctgaaagtctccttgggagtgtgtgggtggggggagtcgagcccatctgttcatgggcaggtgtcagccaaagcccttgcgggtggttttgaggttggtgggagaaagcatccgtggggtttagagttgtggccttttcactacttgcagttcctttccccgacttggctttactttctggtgtccaggggtctgggccagatgctgagattcctctcagctgacaggtgtgggttatgggcaaacccttccctggaggacataaggcaccggattggactgctgatgggttgctgttggagttgtcagggccttggaatagtcttcagatagacttgggttagtgtgacctggggcaggctgcaggtttggagccatagtaccccccgcccccacaccgggcaccctgctctgggctaatgtgaggcttgcaggagtgagtgatgcagtgggaaggggggcctttcctgaggattctacagctttctccagggaatcctcccaggtagtttaggcctgcaggtgctatgctatccttctttcctaaccctgtctcaggtcctcagcggggccatgcggcatccacttataaccctgcagcgaggccctcttttctggccacctgggtgtttgcctgctgagatgggaggaacagtggccttgggcttcttcccccgtcatgtttatctctgctcagattgggcagcagctcaatgggacttgaccagctgtggcactgccagtctgaagatgagtagggtgatggggggaggtgggcagtacctgaagctgaactggtgagagaggcaggctggcctgggggctcagctggggcctgggatggttggtacagtcccctcaggggggtaggggagtgagtgttagactgcttaagcctcagaggccgctcttgcccacctatgctttgaggagatcctcttcatttgttcaaagggaagactctgatctagagatgggcacttggaccagcaaacagcagctacaggtagccagggcacccgaggagcacttgctcatgagccggtttccctggtttttatgggggctgttgctgagcgtctgccagggtttgtgtcctagcacttgctggtctttgctgggctctcagctctcaggtgtttctctaccagcacgtttccccctccctcatatgcacacatgtggacacaagcaggctgcccaggacagagtgtactttgaggcttgggaaaggactctctctcgcccttttggggatgagccttggaacctcatcaccttccggcttggggtggagcttcatcctgggggttgaagctttaggctcagataactagtcttgtaagccagttttgtcctgttgtttttttcgtggaaaataatgtattgacgtatacacagacattctttgtctaacagtctgagattgagaaataccctccatgactatttggtttgctttcatggtgaaacttggtcgctttcttagacacagcctatggcaataagagtgatccctggctgctgtaattcattccagactttgagcaaacacaaggcaccgcctccacctgcagtggagcctctgatgaaccaaatggaaactccttggggaatggggagtaagagccaaatgtgggattggacttaaactgcagcttcttagaactgtagcattccacgatgggattgtctagtgctcttcctggaggttactattcaatagttggctagtgcacaggttcaggggtgacctgatatgccctagcgtttcagaagatccctgcaaggtgtgtcttttggtccatctgaagggtcttgtatggtgatcttgtatggatatccgtgacggctaaggcatctgataacttcattccttcagttccagcagtgttcctgtattatgctgggcactagagctacaaagaagaaaacaaagtgcctcctcttcaggaactcttaatttaggcaggggaggcataattgaacagtgctgaggtcatctaggggaaccaaagtgtgtatttatccccttccctatcactcccctccctccttcatttcttcctttcttctttcagaaactccaagttcatatcaaaattctccagccctggttttatttggttgtgtgaaaattttcctctaatttctgaagctatgcattagttctgctgagtaatctttaacttgctgctttataatgattataatgagatatcactgggtattatggtctttgggtagcagcagggtagggatttccaggctgggactaagctaatttatgggttgggaattatggggcagttaatagcaaggcagtccaagctttccacagattccaccctagggaccatccagacttaaggaacagggccggcaggctcatcccctttgcactcagctgggctatgggtgtgtgtttgtgaaagaggtttattcagtagtcatacctgctgatttccctgctatctgtttacccagtgcctcctgtaccttgtttcttactctttgttctctgctcttactatgaagaagcagagactggaattctgcttgaacccacatctacctggaaattccagtttttcttgtccagtggagcagcaatccagttgttttaggacaaatggtctgcccttgaagcttaaatcctttgagggcctggcatggtgacagttttacatttggctttggtatagactggtgtggtccctgggcagtgaggtcactgtaaggccagccagccagaccctggctcctaggggaattaacaaggcatgggattagactcacagggtccctcctgtccctaaacttggtaggggttcctgggagccagactgcgattaagattgtagagacctgagacctgagttgtaggggcctctgtgttgatctgggccattgccgggtgagctgaggcggtcactagctcaaggagtgatctcaggatattgttctgtaagtcagagacctccaggttggagagtggggcttgggggtgggggacagggtttagtggggagctggttctgggtgaatgtggcctaaagggatttgtccttagaagacagaggggtgagtcacacactcagtgcttcaggttccactttgcggcttggcctcagcccgccccttccctgcacaaatgaaggccaggggctatataattggctgttgctgaattctttggcagtgattttaaagtctggtctgggtgtgttatgtagctgcttctctatccactccccacacccgctgcttctccagagcccctcacaaagcccaggcagagagagagagagagagagagagaatgacttgcctcacagagatgttggggatagggataggggtatgggtctttgcttttgccttttgaggggggataatctcttccttcattttaaaagtaaaaagtaatgcaggctcattgaaaataatttgaaaagttgaaagagatataaaagcacacccaaattcctatcacccaaaagaaacataccggcatatttcctactagtctttttcatgtttaagaatatagctgatatatttttttttctttttctttttgagacagggtttttgctctgtcacccaggctggagtgcagtgatcacggctcactgcagcctcgacctctcgggctaagcgattctcccacttcagtctcccgagttgctgggaccacaggtgcacaccgccatgcctgactaatttttgtattttttgtagagatggggttttgccatgttgcctaggctggtctcgaactccagagctcaagtgattcacctgccttggcctcccaaagcgctgggattataggtgtcagtcaccacacccagtgttatagctgttgtctttatagatgaacagatagattgacatagattcatgtagatagcctggtgttcagcatttttcatttaagattctgtcacagacttgaccctatacctttaaaaatcacaaaggcagtatcatagtctgtcagctgaatatgccataacttaaaaaaatcattcaactgttgctgaacacacacatatacatatatagtttttgttttttcttagtgatgtagtgatgcttgtgcagaaagctttatgtactttttggatggtttctgtaggagagctttctaaaaaaggaaaaaaagtgttgaatgttttttgagaagggctagattttcaagccagtcttacaaaaggatagactcattggaaattccagatttgcttagtgctggcagatgagtatcacttattgctgaacaatgtgtctagaattctgattaaaaaagaaactaggtccaggaagtgcctgggggcaggggcaaagggccaggctgcaggataggctcttaggatctggctgagcagaaatctgctgtgaacagaatcggtgggggtgatgctttctcagtaacttctccatttgtttctttagcagctaagtccctgtgctggacttctgtggactactgtggctctggggctgtggttgtgggtgaacaacagctagctaaaccagtgctgttgacatcattgagatgtgacgcacaggaaggtgggagcaagcttgcaaatcagattctgaaacatatagcacagctctcccacctccaggtggtcctgagatctagggaggagccatagtgagaaactttaggtttctaggaattctcttagggagaagctctcttagggagaggcagaacctggttctcagttggggctgattcaggtgggttagatcaataaagcctcaggccagtgtgccaggctattcccaaggagtatactttgaagttactccctttagaatgtcctcagtggagataaattctctctgaggagcagttttgtctgccggggtcatttggcacaaagcctggagtgctagggcgaggttgcactgagggaaggggcaggattatgtcagcagtgtgacggatacagtgtgaggtcaggctccttcctgccccaccacgggggcctagaggtcatggggagggtccctggcaggggattcaatcattgcttggccccatgacagagtatattctaaaaatgccttaagtttttttctttcaaagtttcttcctgttttgcataatggccttttgcctttgacatcctgaaaccgcagagctgtcattggtgttgcaggacactgccagcttgaaaaaaatcaacaacaaaaaaagaaacaggaaaggatgtggagttcagggtgcggcctagggaagctggtatttgcgttatgggattgtggggatgtggtattaaggtgttgggtagcgcctgacatttagaggagtactctgggcagagtccctgcctgcccaagaataggtagaattgagtcttcacaccaaagtcaggagagaccccctccccccaggaagagaatgaacagggactcatttcctcattcagcaaacttttattggtaactacactatatgaagtgtgagagatagacatgaacaagagaggcccccactcttgggcagtcccttagtagtagtagatagactctggcaatatggtgtggtcagagagaggaagcctgggtgctttgagggtactgaggaggtgcagggagccaaatgggtggtctgggccagggccagagtcagaatgaaggacctctcttccagacgttgattttagcatctctgtctctcagtatgtttgaacagtctcccttattggaagggcaggagtctactgctaaaagtaacctgcgatttcctctacttgctgtcatgtggaaagaatactaaagctgaaattccaaaagttgcacacctttaccagcagggcaggagaggaaaggaaatggaggcagagtgagctgaagatgataaaagaaagagaaggtggtgcagtttggactgttatggacagaggaagtctgagggtagctggactgagggatcaaagggaggcagttgaaagggaagagagctgcagagagggatttcttggtctgcagagggtaggagcaagccttgaaggctgctggagtgaggattccgagccctggtctttattctttttctaattcattacatcattttaggcaagtcctaactcctttggtctctgttgtctttctgaaatttgagtgggctgggcctgctggtctttagcctctgtctttctctacctcctagattccagtttggcgagtgggggggaaaacctggttgtatatgcaacgtgaaaggcctctggaattccttttgaagctcactacccatgaggcttctgctaaggatttcatcatgtctgtctaagcagacataaaaattttagcaggtggatgacccgtagaaatggcacaaggaatgtttctttctgtcacactgtggtatttgatttaagaaagttgttatcctctctgtgcctcagtgttctcacttgtaaaatggcaataacagtatccacctcatagatgttatgaaatacaggtagtagccacgaaagggcttaaaacagtgcctaacacagaataagttgtgaatatatgttatttattattggtagtataatgcttatttgtgaagattttggcttttgctttataggaccttttttttttttagttgaaaatacaatgttaccatgttaaatgttaaaaaaaattctacttaccattgtaacagaacatgctcccacttctgtaacagagcttgctattacttttcaaatgcatacatattccaatgcatatattccaatgcagttgtagagtgaaactgtttgcatgcagccatttttatccaacattatcttataaaatgttatgttgtttatgattatcctaattatcttttgttgctgtctagtatccttatagatattccattagcatacactattccaggtttcactatcgtcgataatctagatatgaacatttttgtagtgtgtagctctttgcttcagttgaattactttcctgggataaattcctggggaagaatttctaggccagaggatatggtcatcttgacaatactgattcacattgctgcattgctttccaagaggtttggaatcattcacaggttctaaattggaaaatcctggcttttgaagtatgtggattctaagggcgatttggatctagctggagcctcacactgacacttccagccagtgtgtgtgtgtgtgtgtgtgtgtgtgtgtgtgtgtgtagttccctatgctggacaccgtgtgtgtgtgtgtgtgtgtgtgtgtgtgtgtgtgtgtagttccctatgctggacaccatgtggcctttctggacattagggttttcctgtgattgcctcagagcagttcctgttgaattcactctgtgtccacaaaaggagccttactgtggctctttcaacacccacctacctttgccaagttggtttacagaaagtaagaacattctttccttcttccttgatatgtggcgctaaacctatagcatggggcaggctctggctttaaaaacctgacttaaaaataatggtgttgatcaaaaagtttgtggatcagtttttggaaacactgcatgtagccatccatagaaacttatattctgttgggctagcctgggcgcctgatcatttaactcatgtggatgaacttctatgtaatagccctggtgtatgggatccagaaacagggccctaatgaagaaaggcttttaaattatgttggataaaaataagttgttacaatagcccaaagtctgcaaatatgaattgccagttctgtccttgtagtcatccaccatgtgcctgcatcttttgtagactcttgtagattcagaagcccactgaattgcataaatgatggaatgattttagacttagtgatttcagtgactaaaagtttacagatcctggccgggcacagtggctcacacccgtattcccagcactttgggaggccgaggtgggtggatcacctgaggtcaggagtttgagaccagcctggccaacatggtgaaaccttgtctctactaaaaatacaaaaattagccgggtgtggtggcatgcacctgttgtcccagctacttgggaggctgaggtgggagaatggcttgaacctgggaggcggaggttgcagtgagcccacatcaggccactgcactccagcctgggtgacagagtgagactctgtctccacctcccccgccccccgaaaaaaaaaaaagtttacagatccagcagatggggcatattcaatttgtgacagccactcccttcaccttatagctatgtcatatgtcttcttctcctttgactgcattctgcagcagtcagttgtgacttaatatggcactctgggcccactgaattaggtcagagctgctagtagtatattgttcctagagacctagggcaagattttcttactacataaaatgagggagataatttcttacctcaagatgttggtaagaggagtgaatgaggttagttatatggtaatatcagtactctgaatgtcttttgatcaatgcctaactcatcttcttgggcacaaaaggcatacagtcagcacccttaggccacatataaaattcctccaaatgcaggttttcatctgccttggggcagagtcaagagaaagaagaggaagaggcgtgaggctctgaccacaacttagggacagaatatagcccaaagcgagtaccccaggccacaaggagaaggccgctatcttgttgaatccacagcactggaaacttggagtgtgtgttcccctgtgtcagttacactggaattttatggctgctcacattcttcccttcaggtggacgttgttcatcagtatcctgggcaagaggccatcataaaccacagacagctgagtgattaggaagaggagctgaagagggagcattagatgtttgattgagtcttaggtgagaaagtatatcattaaaacaaaaagatagatgtaggcgggctcagtcttgtgtgcctggtgtgttggtagaaaaactaaagcacaagcctgtagataacctgctttattctacctcggggctggtgttggaatccaggatgccagaccctaaagtccagctctctttccaacctactgaataatccgagagaaatcatgttctctctctgggcctcagtttgcccatgtataaaatgagatgaaggattggctgggatgctctccagagtctcttcctgcctggagttctgacgtagccatgtactcctgctcagcatcgctaaatggctttgtggtaggaccattgagtgctgcctccattagggccagctatgtaatgctggggtggctgtcactgggccctaagagccaggattggtcttactggagaaatccacatccacctaaacttaagacccaggggtgtccaatcttttggcttccccaggccacactggaagaagaattgtcttggaccgcatataaaatacactaattatagccgatgaggttaaaaaaaaaaaactcaatattttaagagagttcatgaatttgtgttgagctgcattcaaagccatcctggccgcatgtggcccatgggccatcggttggacatgcttgctttagacctcccagcaattctagtctctaaacaggaaatcaaaagtcaagatgaatagataagttggtcagtgtgaaaaagtaattggtgggagccactgtagatgcagggttctaggctccatcaacaaccacctacatcactgaacgaaagataatgcttgttcagcacttattacatgccaaccatggtaaaaatacttcagatgcattgttttcatgaactctcacagcagctctttttcttgcctaaatgccccgttagaacctccagtacaatgttaaatagatatgctaagagacaacatatgtgtcttgttagggggaaaatatccagtctttgactattaagaatggtgttagcagtgggtttttcctaggtgccctttatcaggttgaggaagttcctttctattcctggtttgttgagtatttttatcatgaaaaggtgatgggttttgtcaaatgcttttctgtgtctgttgagatgatcatgtttttttgtcatttattctattgatatggtatattatacattgatttttcagatattaatcttgcatacctgggataaatcccacttggtcatggtgtataattctttttatttgttgctggattgagtttgctagtattttgttgatttgtattcataacagatagtggtctgtagtctttccctccctccctccctccctccctccctcccttccttccttcctctctctctctctctctcccctcccctcccttcttttcccctcctctcccctccccttccctttcttctctttcatagttgtttaccactgtcagaaaaggtctgttcgttttctttcgtcgtgagatctttgtttggttttggtatcagggtaatactgcctcaaaaaatgagtagggaagtgttccttcctcttctgtattttgagagagtttgtggtcggtttttattaattcttctttaaatatctggtagcgttcaccagtaaagccatctgggcctgatgttttctttgtggaaaactttttgattcctaattcagtttctggttataggtctattcagaccttctattttttcttaagtcagttttgatagtttgtgtcttccaaggagtttgcttcatctaagtcatctaatttgttggcatacatttcatagtgattccttatgatcctttttatttccgttaaagttggtgtagggatagtccctctttcattactgattataataatttgaattttctttttttcttagtcttgccaaaagcttgtcatttttattgatcttttcagaggaccaactttgagttcattatttgttctctttgttcttatttttctgcttcattaacttctctaatctttattctttcattctgcttgcttttggttaagtttgctttttctggtgtcttaaggtagaaggttaggttactgatttgagatttaaagatcatgctctttaaacgttttgatagatactgtcagtttgccctctggctttttctcattaacagtgtataggagtgcttattcctcacactcataccagccctgggtgttactaacctttatatatttgccagtatcatattcagacatagtatcttgttttaatatgtttctctgattactgatgaagttaagcaaattttcacgtgtttattggccatctgtctttcttttttcatcctttctttcaagatgggagtctttgccatgttgcccaggctggactcgaactcctgggctcaaatgatcttcctgcctcagcctcctgagtagctgggactataggcgtgagccaccatggctggcttgcccatttgtatttcttatgtgagtattttttctttttttttgaagtggagtctcactccatcccccagagtggagtgcagttgtccgatcttggctcactgcaaccaccgcctcccaggttcaagtgattctcacaccttagcctcccaagtatctgggactataggtgtgtgccaccacacctggctaatatttgtatttttagcagagatggggtttcaccatgttggccaggctggtttcaaactggcctcaagtgattcacctgcctcggcctcccaaagtgctgggattacaggtgtgagccactgtgcccagctgactttttttttcttttttttaacccttttttttttttaccctttttttggcccatttttttttaccctttttcttttaacccatttttctattagttttaaaaatatgtttgcaggagctttttatattgtggatttttcttgtttattacatatcatttgtaaatatggtctctccatctgtcactcttctttatctctggtttctttagctatgtagaagttgttatgttatgttatgttatgttatgttatgttatgttatgttatgttatgttatgttattttttggagagggagtcttgctctgtcgcccaggctggagtgcagtggtgaaatctcggctcactgcaacctctgcctcctgggttcaagcgattctcctgcctcagcttcccgagaagctgtgattacaggcacccgccaccacacccagctaatttttgtgttttagtagagacggggtttcactatgtaggtcaagctgatctcaaactcctgatctcaaatgatcctcccaaagtgctggggttacaggcgtgagccactgcactcggccagaagttttgaatttttatgtgtttaaatctatgttttcctttatgacttcaggttgctttcatacttaagcaggtcttcaccatcccaaaatgataaaatttttctcctgagttttcttctaagttggttctttagaagccaccaacttggcttcgacagcaaaagatgaacagaatttctgttcaactctcatgctgcaagaagctttatgtaatactccagggaccctttaaggtcccagagttttcctccaaatctatcagtgattctagtggctaagagtagaaatgtgaaaatttagccatgtgtgctgatagagctgtagtaatttgtaagctctgaagttctaaggagtcaggggagaagggaaagtaacatttattgaacatctattagctcaataagaacatgcgataagtatgtatatgtattatttcacttacatctgaaaggaaggcataattatccccactccttagagaaggaaattggagctggctacatttaaagtagtcctgacaccagagagatattgccaggagtacttggctggctgagtgcccagatggcccataggagtagtgggccctccacagtccaaggtctggttctaggtggagagagaaggatgtgctcgtagtcagcaccgcagctccagaaaatctgctggggctccaaaactgattagaggggcagctgactcagtaataaaactcccaggagacttacttacatactggaatgcaaagttgcagctttactgggaagattagaactgttattgagtagcttagaaatctctggctgaattcactgcaagggaagccgcaggataagctaactgctggtgagtcagcagtcagagcagggaagtgaatttaacattagatgggtcagtctctcgtggctgatgaattcatccccacaatactgtacacctgccttagggacctttgtctggactaggggttggggtccccctcctttgtacagccctggaaggacacatccagctccatccgccatctctcccttacttatttccttccttccttccttctttccatccagccatcaagcttcctttcatggccaataatcatcattggggtctactcatggactctcttgcctcatgtatttgttttattttgtcctcattcccacttctatttcccaggtatatcacaggcaactattctaacgtatttatagtttgtgtatctgtttttgctcttgccaaaatggaagccactgctttatacatagatgtattcttaactttaaaaaaaatttttttagattaacctacaataaaattggctttttggcatatagtctataaattttaacacatacatatttttgtgtatctaccaccacaatcaggatacagaacagttccatcaccccaaaaaaatccctcttgtagtcacattctcctcccacccttaatcccaggcaaccactgatctattcttcattactattgttttgtctttttgaggatgtcacataaatggagtcacacagtatatatacatttttttaaacatatgtaaatggcattttatagctcattttgattatatgtttttcatccagttctgttttttttttttatttttaaaaagtttgacataacttcagacttacagaaaagttgttagactaatacaaagaattcctggatatcctttggagtccctaaatgttaacattttactatatttactttttccttctctctctctctctctctcgctctgtgtgtgtgtgtgtgtgtgtgtgtgtgtgtgtatctacctgtagatagatagatattaatataattttagatagatgtatctagatctctctctctcatatatatgtgtgtgtgtatatatctatatctatatctatatatatctccttttacccttaaatattcagtgtatatttcctaacaacaaggtgatttaaaaatatatatataaacatagtataattaacaatcaggacatcaacattgaaacatttctgctatgtcatctacaggccttaggaagactttgtcaggtgccccaataatagccttgatggtagaagaaaaccatgtgttgtattcagttgtcatgtctcttagtgtcttgtaatctgaaataattcccaagccctttggatttcatgacagtgacattgttgaagagtacaggccagttattttgtagaaggtctctcagtttaggtctgtctgatgtttcctcctgatcagattcaggttattcacttttgacaggaataccactgaaatgatgctgagttcttctcagtgtaacgagatctagagacacacactgtcagtttgttccttattggcagtgtgaaccttgaggatttcattgtagtggcatttggcattactccattatagttactattttaccattttaaattaaaactatctggccgggcgtagtagctcatgtctgtaatcccagcactttaggaggctgaggcgggcaaattgcttgaggtcagaagtttgaaaccatcctagccaacataacatggtgaaacgccatctctataaaaaatacaaaaaattagcctggcgtggtggcgcatttgtagttccagctactcaggaggctgaggcacaaggcttgcttgagcctgggaggcggaggttgcagtgagctgaaatcacgccactgcactctagccagggtgacagagtgagactctgtctcaaaaaaaaaaagtaaataaataaaaaaattttttaagtatcttatgggcatatacttgtcctgttactcctcaaactttcatccacttttttttttttaaattttttttcttacctttcatcgttttcttgatatccactgggttttagcatctacaaatgattcttgcctgaatcagttattatggtagttgatggttttctaattccattattccttctatgtttgttaattttggcattcttctataaggaagagcttaccctttttccctattaattaattcatatattaatgcagacctatgcattcttacttcattaaatcataatcctttactatcattatgtattctgatgttcagactatcccagatttagccaataagatccccttcaggggaatggtctttgggattcctctttagaggttcctggttcctgttttcttttgacatatcctattactctttgagcatttttttttttttttttacttttaggcacagcaagaagttccatggtcctcttgttctttccccaactcagccctagagtcagtcacttctccaatgagctctagttccttttagtagagaatcataattagaaaacaagaatcagtgccaagtgtgcacctttgtttttaaggtccatccacgttgccgtgtatatgtccagcatgttgattctaactgctgaataatacctcatgattgtcatccatcccagtgtttctttttcccttctgtaatgagggactcctggactgcctccagcattaccttcacaaatattgctgtgaggaaaatccttaaacgtttcctttatgggcaacgtgtgagcatgtttatgttgattcaggggtgccagacacagctccagaatggctgcctcagtttacatttccaccagcagagcatgacaggctctgtgtctccgtgaataatcagcattaaccagcttcctattttttgccaaactaatagatgtgctaggataactctttgttttaacttgtttttctctgattaccaatgagctggagcatttcttcatatgcctgatggtctttgggattcctcttaggtaaattgcttattcattataatcctttgcctgtttttcactggagttcttatatttttcttgaagatatgcaggaattccttatacatcctagatattaatcccttcctggtctcagacattgcagatatcttctgaatctgttatttacttatttatttacaattttttttttaagagttggggttttgctctgtcacccagactggagtgcagtggtatgatcatgactcattgtggcctcgcaatcctgggcttaagcgatcctcccacctcagcctcctgagtagttgggactacaggtatgcaccaccagacttggctaattttattttattttttagagatggaagtcttaatatgttgctcaggccaatcttgaactcctggcctcaagcaatctttccacctcagcctcctgcatctattatatatatgttcactttgctcatgctgtattttgttgcaacataaaactatttttcccattgttttgtgcagtctctcaccagcactcttctttttctgtaactgtgttaatgccctttgttcttccatatgttaggtatgctggtatagttgaactctgctgactctcctcagtaaacagtctctttttatgacaccttatcctctactgaattctctctatcaagaatgacttggccgggcatgggggctcatgcctgtaatcccagcattctgggaggccgaggtgggcagatcacccgaggtcagaagttcaagaccagcccggccaacacggtgaaaccctgtctctatgaaaatacaaaaatcagctgggcgtggtggcaggtgcctgtaatcccagctacttgggaggctgaggcgggagaatcacttgaacctgagggggaggttgcagtaagccgggatggcacattgcactccagactgggtgatggagaaactccatctcagggggaaaaaaaaaaaaaaaaaaagaatgacttgtcttcctcttagagtgtgaggtctacatacaaatattattcttgtattcagcaaatgtatgtcataggcctagtgtgtgttaggaactgtgctgtcaccaacaaagtttagagaggttataaaacttgactgtagctttttagaggtggaggagtgatttgaaacctaggctgtaattccttcctcctgtgattccttcctactgtgttgccttcccttgaaaattgcatttgggggccaggtgtggtggctctcgcctgtaatcccagcactttgggaggctgaggcgggtggatcacctgaggtcaggagttcaagaccagcctggccaacatggcgaaaccccgtctttactaaaaatacaaaaattagctggatgtggtgtgtggtgacatgcacctatattcccaggtactcagtaggctgaggcaagagaatcacttgaacccaggaggcagaggctgcagtgagctgaaattgcaccactgcactccagcctgagtgacagagtgagactctgtctcaaaaaaaaaaaaaagaaaagaaagaaaattgcatttagttcctgtagactgtgtgtcaaatgtctaaatctcttctaacaaatggcctaaggaggtgcaaagcgaagcatcctcaccagcatcctgacttggcagtgaggcatgggaccctggagggagtagtggtaagtgtgactctggaattcttcctgggctacttgtcagtgactggctccagattgagaggagagcccagaggacacaggtggctgccccagcctggaggtgaaagtcttaaaataaaatgccagatgcctagaccattctaaacctttctgagaagctgaaatcatcccttctggaagcgctctagttctaaaaggacagatatacagcaagatcttcctggggctaatatggagtttataggcaagtaggcctcagaacctttccctggtagtgatatctgtgggcaggcacagtttccacactttccagaaattccagcggaaggagtgagaaggaggaatctgcccttgagtgaggaccaaagaaagcagaaattcctcttgggaatttttcctccagagaccaaacactacttgggagcttgtttactgggctttaaaagcttgtgacccccagtcactctttcttgaccccaaggctttgcatttctgtggcttccccactggacagaagtggaactgtcatgctgcctgttctggggtctcccagaggtttccccatgtcctctccttgcttctactgccccacagaattggggatctgtgaccacatatggtatagaattaatgcttgagaatggtttagttcagtgatgtcaaataagattcacttttatgccacctccatcagttgaaggcccccctggcccctaaattggaaaagattctgagacagaatccccgtgggtacagcgcagggacagtaaaggcacgtgtgctgtgatttgctatccactgtgtggatgcatccaggaatatcagaaccctggaagattatttaaggggaagttaggacagcttttttgccaatccaagggtgttcttgaggaagtctgtcttcctgtatggccttcagtttctttcctgtgtaaccatggggccaacacataattcccacagctctattggcccttgtctgccaggattctctagggtctgattcgaggtggatcctggccctttgaggtggcagaatctgatcatggtgctgtttccttagatttaggccttgatacccttggcgagagcatcctgggctgagtgaccacctgaggtttttctggtgattttgtgacccatgtaaaactttgagctttgggattattctctcaaggaaatagtgacatttggtgaagagcctgtttggtgtggctatgtgaggcttagccaagaaaatgcaccatttttattaggaggttaggccatccgttgccacaaagtgtcagatgctaggcctagagcctggagaaaacttattttaaaattgatggggtgctggaggggttggggggtggtggctgtagctcatgaatcaggtgctaaacctagaaacaaaaggcctcatgtggcagactgtttctgagcacagatgaatggatgagcaactggcgcaactttgcccagttggtccagcttcccacttggccacctaggcttgctgtgaagacctcgtctggcagaaatgagagtgtttttgccccatcttgatcttaactgtaatttaagactaaaatcttagattctaaaacatcaaaggcaagatggctcccagctctgtgagctcagcttctcacctcttagttgaacaagtgcagtgtgggtcaatacatgattgctgctcttgctgccaggaactgtcccagcatagaaaggaatgggacacaatccctgccgtcaagattctaagggaggaagcaggcaggtcgactggtgcctcatctctgcagggctccagccaaggtttgtgaaggattttgcaggcatatggagtggggactgattgatcccgagaggggactggggaaagctctgaagaggggatgacatttggtttgaactccaaaaaatggttgctttacctgtttcctgaagtttttgaggtggcttataagaacatataccataaaaaggaccaatataaatttaaaatcagaaaaagagaaaatgggctgggcatggtggctcatgcctgtaatcccagcactttgggaggccaaggtgggtggatcgtgaggtcaggagatcgagaccatcctgcctggccaacatggtgaaaccccggctctactaaaaatacaaaaaattagctgggtgtggtggcacatgcctgtagtcccacctacttgggaggctgaggcaggagaatcgcttgaaacctgggaggcggaggttgcagtgagctgagatcgcaccactgcactccagcctgggcgacagagtgagactcctcctcaaaaataaataaataaagagaaaatggaacttagaaaattaagaggaagagtgaaaaggtagatatttagtcaggcacagtggctcatgcctgtaatcccaacactttgggaggccaagacaggaaaatctcttgagaccaggagcttgagacttgcctggcaacatctcaggtgagaccttatctctacaaaaaatttaaaaattagctgagctgtgtggctcgtgactgtgatcccagctactcaggaggccgagaccacagcccaggaggatcgcttgggcccagcagtttgaggctgcagtgagctggcaccactgcaattcagcctgggctacagagcaagacccagtttaaaaaaaaaaaaaaagatattcaaaccatgggtcccaacgtagttattatatttgaccatttgcaaaagctgaaagcaaaacatgttacacattttcagagaggaaaatacacagtagttcctgagtgtaagttgtttttcttgacctcattcttaaattgcttcatgagggtgggagggaagtggtagttaataagtgaacctgtaaaccagcgtttctcaaaatgtagtccagggaattgcatcaaaattgcagttacctacagtgcttgttaaaatgcagattcctgggcccctgccccaggcttatcaaatcaatctggtgagtaggactcaagaacctgtaaattcacatacttctgcagatgattcttcttgcactgcacagcatgaaagcctctgcaatagacagaaagctaccagcattgcgaaagcaacttgagtgcttggcctttgaaggttgagtgggactttaatgagggagagagtaaggcatgagaaatggcagttccactgaggtcagtcagtggttcattgctgacgaagtcacttttaagtcatgttttagaagaactaccaagtgtggcaggtcaggcatgtggcaggactgtttctgagcacagatgaatggatgagcacctggccccactgtgcccagttggtctagcttcccacttggccacctacggtctgctgtgtggaccttgtctggcagtctcctttaatttattttttattatttttttctttttgagatggagtcttgctttgttgcccaggctagagtgcagtggcatgatctcggctcactgcagcctccacttcccaggttccagcgattctcctgcctcagcctcccaggtagctgggatcacaggcaagtgccaccacgcccagctaatttttgtatttttaatagagacatggttttaccatgttggccaggctggtctcgaactcctgacctcaggtgatccacccatctcagcctcccaaaatgctggaattacaggtgtgagccaccgcacctggcctattttttttcagcaaattctttgtttttctctctgttcccaaatgcagggtactgagaccacagatgtattctgtttcctgttgaaaaaatgtttctcacttagctgggtgtggtagcatgcactgcagtcccacgggaggctgaggcgagaggattgcttgagcccaggagttcgataatcatgccattgcactctggtctgggtaacagagcgagaaactgtctcttaaaaaaaagaaaaagaaaaagaggtcctagggaaagaaacaaatagtggcttggatggtgagttggtggaaagaacagtgggtgttgggggtgttgaacttgtgtttgtgtgtggtgtacccaagacatatcatgtcagcattaagaatagactattcctgttttctggtcactgagttgtatgttttgacatccttattttggaagatacttccttactaggaatgggatagggagggggtcacctttcccatctgtgggtcatattttaaaatatttattgttcaagtttaaagatataaccaaaggtataaagaaaaataccacaaacatctgatttaagaaacaaaccagccgagcgcggtggctcgtgcctgtaatcccagcactgtgggaggccgaggcaggcagatcatgaggtcaagagatcgagaccatcctggccaacatggtgaaaccccgtctctactgaaaatacaaaaattaactggtcatggtggtgtgtgcctgtagtcccagctactcgggaggctgtggcaggagaatcgcttgaacccaggaggcggaggttgtagtgagccaagattgtgccactgcattctagcctggcgacagagtgagactccgtctcaaaaagaaaaaaaaaagaaagaaatcatttcctacaccttcgaagccttcatgagttagattttgaaacagtgcaaaatgcttcacgtgagaatcgagagtcccttctggtggctctccatcccctgctcttctgtcaggttttcttgtaggtttatggaaacctttgttacttgtgcaggtggcagagaagcagagaggatagctgcgcgccacccacacagctaggatttattggcgtactcccacgtgcatggcagccaagtggacacaactctgtgatgaatcctcccaagagaactgaggggccctgatggaggagctgcttctttgcaaagctttccttgactctcttcctgtcccctagttgattccccttctgtgctagttttagcttattgtttgttacctgtcacacttagcagtactgttggctttgctggtctccttgactactgggggtaaagaccttttgttgttgttgttgagacagagtcttgctctgtcgcccaggctggagtgcaatggcgtgatttcggctcactgcaaccttcacctcccaggttcaagagattctcctgcctcagcctcctaagtagctgggattacagctacaccacacccggttaatttttgtatttttaatagagatggggtttagtagagatggggtttcaccatgttggccaggctggtctcaagcccctgacctcaaggtgacctgcctgtctcagcctcccaaagtgctgggattacagacatgagccaccatgcccagcctcaaagacctcttctttacttgctcaccctgccgcccactcccctaccaacccctgcatgccctataccacctggcacatgatacatactaactgggtacatgtttgaatatgaatggatgtggtgctgtgaatgcttaggggaagtgggtgaaatgcttaagaaccaaccttgagtggtctgggaaggcttcctgggagggtggtgtttgagctaaggccaggcagctgttagatttgttagactgaagcccttgcagacttagagagcttgtgctcttcccagaatgacgggtgagccacgtacagtaaatggtgcttctcatttctagcccaaggggcctcaaggggcaccgtgatttcacgagaatgctgcaagcaaatcttttctcaagctggggaatttggtggtaatgcctggctcagcttgcggtgcgcacctggcctttggaagattggtacagagagaagcggcccatccacatgagcctgtggaacagcactggtgggggagctgatttgtgaagaggggctgtgcagtgtactgtcaggtctgagacccaggaagaaattccagtatcccagctctcagaatcacagagttctaggcactgcctagttccacgtgttcccaaatgtttcctgaatacttggatttcctgtccagagaattttcaaaacaaacttagaggcctgacccatggctgccaaggaaggattttttttttaaattaaattttaaaaatcagtccagcatgaaaatctatgatgatttcataagagaaaggacattttaatattcaaagagtaagaagcacttaatcttggaagaaagggcattcctatactttgattacctttagtttaattaaaaaacacctacatggtctttacttctgtgatttcattcctgggctagtgaaacattgtcacaataaagcatcaggccaacgcttctttcgacccactggccaatcagttgacaaacagtgactagatgtttcagcctattttgctgaggctaaaggattgaactagtgcttcagccagcatgaaaaccagtcaggagtccgtgctggtgttggcttagattagcagggcctttgatggaggggcatgtatgtgtttgggtttgctgtgccaggcaggggagcagtggaatttgtctgaattgagctcacacattgaagttattgagcgacttacatgcaaggccatgacctggactcccagccgagaggcccacgtggcggggcttgagctgggggagccgaggacagcttacatctgctcatctgcttacgtaaccctgcctcccagcttccagagccaagaaaacacacaagccagcccagcggggccgagagcctgtggtagcacacgccatgcgccgcacagcaagggcgccttggctcggcttgaggcctgtcatgaagccctcagccctctgcctcctcccagagcttctccccaccaccccaggcagtggctctgaaacctggtcgcaggtctgcatgattctgaacagaggtagtcgttgccttcctggagtctgagctctctggagtttctcactgggacagagccaggtgtgtagcagagcatggtccctgcagtatggcaggaggtgtgcagggcattcaggaggcctcctggctggcactcgacccaattagtcattcaacgccaggtctggggctgctgtctgttgtctcaaaggtgtgagctgcaagatccttagagttgtggagaaaaaattgccagattggcaagaagggcaggattgggggtcaaggtgtctcagtgtgttggaagcatgatgggggttgtgcaaggggcacagcgagttcagaagggagcaggagagtgagaagaggctgttcagtgataaagctctgcacagagccattggaggagcaagctccttgaccatccttaaaccagggtaattttcatttaggttctgccacacgctcagcagggaactcctggaaggcaggatttgtcttgtccatcctccctccctacctcaacccactcctccttgggctggcacacagtaggtacccagaaagtatcaattgaaacaaattgaaagtggtcttgatacatatcacagggcaagtttgcagttaacagacatttcagagtaaagactctctggcttggtgctcgatcggcttctgtgggttgtcagcatgctgtggacagccccggcatgggagcgagtgggcgtgtgtgtgtgtgtatgtgagggtgagagagcgttagtgtgtgtgttggggttggggagagaggagggggaatagaagatggaccacccgggtatcagcttctgccctggggagatggtggtgtcagttgctgagggaatcctgagaagcaggtctggctgtaggtggtgatggtggtggggttgcatgagaatccatttggggcaggttgaatttgaggtgcccatgacatatggctagccatgttctgttggctgtgaggtcaggagagagacatgagatggaaacagaggtttgggaactgtcatgtgcttaaaccaaagacctgggtatagggagagtgagaagagaagggggcaaagatggacatccaagaaagaagctgagaaagcctaggaatttgaggtaagaggagacgtaggtaaatgtgacgcttggtgatcaaggcttctttccacctctcctatgctggacactcacgtctcctgtctgcttggaaattcatgctgagggcagggaaggtgggagcaaggatttgtctaaagatcttgctttggatccctgcactcctcctggtttaccaagtgtcactggacacgtcagggcgttctgagaccttagagagcatccagtcctgtccctgcagtttacaaatgaggaaaccagtaccctgagagtggctgtactatccactctcaggataccaaagatcatctggaaagtcactggtggagctggaccggggcccaggcatctcttctcctgtccggggctcttgacttcaggaccacctttctgaaacccatgatggggcaacaccaggacactttccagcctgcaggtgtctgtcccgcggaagcgagccaggccacatgtgaattcctgttttctgggtgggtttcagaaggtacgagcaagtcggcagggtgacagcccaggtgcttcttgggttccccaaaacgcggttatgtttagcagcatcctcagaaccaaaggtggggtgggggctgcagatgttgtgggggccctctgaagtgaaaagagccctgtgacagatcttttcttcatgtttttcacaagttcactgtgcagcagggcccccccagtagcctttgcccagggttgggtgttgggcagcccaggcctggctgaccttgtggggaagggtgtgaatggtgggaatccccgagggccctctttgcccgaaagccctaagccttgacatcagatgcccatcagatggtccatcggagccctactacccagcttgcccagtgagaatcatctgggctccttgttaggtagccatttaggtccttcccaaaatccacagactctctaagggaagggcccgagatgctgtacttgtactaacttcctcaagcaattcttgtgataggtttgggaaaaacttgtccagggtgaccactgactgagtcctggtcttctctgaagagcacagtgcctgctcactttagggcaccctgggaggtgggagctggctcagcaggcagtcttataagggactgagcttcaaggcctctgtccctccaggagggaggtgcatgaccagagagggaggcctgaggatcttcttccctgccccagagggtctgctgcctgagctctgtgatagcgcagagagtaaaaggatcaagcttgattgaggcctatctctcaatgcgaaagtttgctagttaagaggagagtgggaagggcatttctggcaaagagaaaagtgtggacaggcatggcttaagggatggggagggagacagacagagctgagggtgaagggccttttgctcagctgtgggccttggccttcccttgtgcagggacacacagccttagagccactggaggttttagtgggaaagtaatatggtcggggctgtatctcagaagaaaacaaactaatgggaacaggtcctgtgatggtggacctgggtcagctacggagggagggaagatgtgagatgtgtactggggaagggggtggaagtggcagctatctggtgagaggaagcaggcccacagctttttttctcaagctgttgaattcagaagggcgagtgattccgggagtagggggtgcttggagagccacgcgttattgataaacagggcaggctgaagcctgctcactggccctgggcgggttctcaccagcatgtttcaggttttgatctgtgcttgtggttggtgttcctacctgttctctaggttccttcctttgttcttgtggctcatttgcttcacaggtgaagctggttacactagagtaacagttcccaaagtgtgttccctggaaaaatggttctgtagccaaataagcttgggaaatggtgggttaaatataacgaagggggtttttcgactgcacaacttctcagagcctttggtgtgtgtcgtgactttgcagaagcaggatttaatacgcagcattcccgttcttatttgaccacgagacatgtttttccattaagcatcttgctgggtctgatgttttctggaacccattttgaggcggtctggtctgcagagagtatggggagcctgggttcaagccttggctcttgactctcagcagagccttgattccctgtgttgcctggactgcaccacgtgtaccacatacccggtatgtgacgttttcctcatccctcttcccacctgccgttacctcacaatccacaatctgcacctcatccatttttcttctgaggcaagcactctcttactaacttacttatctcatctgcatccatgttcttctaggccagaaacttgggagtcatccctccctctttgttacttcttcttcctctttgttactttatcccctctgttactaaacattcttctgtgtttccagctatttcttttattttccctcggtctcctttggggtttctttgcctccatctctcccagaccttggttcaccttccatcgagtcccttcctgggacatgggcactcatgccactcctgctaccttccacttcgaagctaactccctccacactgacgtccccaacatgcatgcatacacacacacacacacacacacacatacacacacacacacacacacttccccagttaggctagaatcagagagatgatgtcagccatttgtccaaggccacgcagctgggaggtcacagagctaagtctcaacctcaggggttttgagaaattgccttctcatccgtgatcactgatttctacaacagcctgtcaggaagtctgggtagaaattacttccattttacagtggagtcagagcggggagggtcctgggcaggcgagtgcttcacagagtgaccaaccatctaggtttgccccacactgaagggggtttctggggatggttggtcaccctaatgctggatgtggtgcctgatgctgggcaggagggccctctccgtggccacgttgcctcccaggaggagacatttcctctgcagctgcagctgcagcctggccatctgatgcagcctgtggagcggtggcgagtcctgtggcctgctaacttctccctccctccacctctctagtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggtgaggcctgggaaggtggaatgagagagggtgtgtgtgcatgcagatgtgtatcagatgtgtgtgtaatgagggcaggggaaggggagtgatttcacagacacctggcacttacagcgaggaaccagccccccagccaccaccagtgcagatgaggtaaacgccaaacagtgtgcttgcctattgctgtcaactctatagccaagggaaatgctggagtgttttcgttgttctgtttttgttttctggaagtagccttccagcaagattgggaaaaaagacaaccctaattattccaaagtacacactgattattccctggctttgtgtagctgtgtattttccttttaaaaataaaaccaccatttagatgtcagacttttaggtaacttcaaagtttatccagtcagtcagagcgtgtctcctggggcacctggagacagtgcccttagttcaggtcacatgcctacatgccagcccctggtgaaatatctggagaagtctgattcgtgggccatctgagagttatgtggactgggccgagtctgagaaaaagtttctcactgctcgtctgatccatatgtgttgggctttagccctgcttaggaaagtaatgctaaggataggtcaactttcatcaccatggcatggagaatcagattgatctaagaggcatctttattgaaataaatttttcagtttatttgaggagcattattttcccaagagtataactttgatatttcaagattacccctaacacttaaattcatgtttttagactataacctcctaggtgcaatgacacatctaacttatctaagcacccagtttcattgaaattcatttgaagagtctgagtacgcccatttctacaaggcccaatgtccatttcatttcgagataaactctgctttaggtaggaggattgttggcagtttacggcttccatcaaggtcaaggaactctgtgcaccttccctatgaccccaggggaagcactcgaggactgctgtggcattgtgctgcatcacttgctgcagggagattctgaagaagtgtaaggtctcagtcctgccctgtcccgaagcctccaacccacttctggcaagtgggaccttcccagggaacaatttgttaacagacccaaatatcctgtgattggatggtggctgccaaatgctttggaagctcagaggaaggagagagagcaatggcttggaagaaccaggatataaactaggttctaaagtctgcagggagatgggcttctcagctggggccagtgagcagggaccttaaggcagaaaggagccttgcatgttcctggaaattgagatgcccactggggtaggaaagcaccagaagctctgggaccaggtgtcagagttaagcctgtgaggcaggagagagcagaacaagccctgttacaaggaaactgaagcaggagagcaggtggtgggcaaaccccttgaggctgtttgaattcttcggccaagtgaggtacagaccagggccctatgaacacctgcaagcaagacagccacgcagttgtgggtcaccttggaagaatattggagaatgcaagagagaacaggtaaatgtcctgcaaaatgcgggtcactttaacccaacacatattcatttaagaaaagctctgtgattgagaaacatttgtctgatgccagttagcacataccaatgacggcaagattcaggagcctgttattaaagcagtggcagcgagcacctggaagaggcggccaccatcaccaggagccagcagggatgactaataagccgtgccagctgcatctcgtttctctcttgacagttgctatgccagtagatgagggatgtactgtggatacaatgctgtcatatcttattcagcagggcatctgatagcatcccacaaatctgcctgagtagaagacagacagctgtggtctgggtgccatataggtaggttaaaatatatatttgggcctaggcgcagtggctcatgcctgtaatcccagcactttgggaggccaaggcaggcggatcacttgaagtcaggagttcaagaccagcctggccaacatggcgaaaccccgtctctactaaaaatacaaaaattagctggacatagtggtgggcggctgtaatcccagctactcgggaggctgaggcaggagaatctcttgaacccaggaggcagaggttgcagtgagccgagatcatgccactgcactccagcctgggcaacagagtgagactctgtctcaaaaaaataaaataaataaataaataaataaaatatatacttgggtaaagaggataaaagagttagcgatgatgctgaatttttgaactgaggtggctgttttcaaggaagactggagggtgggatgctacgtctagatatgttgcagtttaggtgaatgtgagacttccctgttttgaagtcaaatattggaccagtaaaatctagccatcagcttaaattcctatgatacaatttacatactccccaggctcaacacagtagatttctgaatgtcctctgccagctacatgctcctgcccacctcaatccgagtagatggaacaactaaccaagccagctcagaccggtggcacagctgtgctggctaacactgggcaccacctaagagagtgcttctccaaaagtgtgcttccccaaatggagcgaaatacgcttgaggaatgttgggttgaaccatgtaaagcaggtctcattcccgcagagcctttggtaccccggtgtacactgtaaccccagaagtgtttcctgagcttgcctgacgagacaacttttccaagaaccgtctcaagtgatgagtgttttgtgagtcacactttggggaaagcgggcctaagttagcatctcctcccagctgcctccctgctttccctggaacactaggaactgcccgtcctccctccctccctcctcttcccacttcacaacttagcatcaggaatattttagttttggtttttcaaacatatatacctccttttttcttatcttgtcaatatcatcttttttttttctttgcttttcctcatacttttttttctcttcatcctttccttctccaagggttaactttccaccttaggagaatcttttctgctttttctcccacttccccagctactctcttatcatctgctccaatctcaccctaattgatcattttgggaaaatatggtcagagtccagataactaagttgagaaatgcttaaactctgccatacctttccagtaaagaatattacctaataaataataaaatggtaatgggaaacctgaaccctgaaaaaaaagaggtggaaggagaaacatttggagcacatcctgtctacaaattaggaactgcctgtgttatctgttttatggttatattctagaagaagaaagggattttgtagcacctggttttgacctttctgcactgtttgttgagcaaataaaccttatgggctgttagccctctttatagcctctcagcttatccctggcccagacaccctgctgtcattttgacttttcattcccacacacacatacacatgcacacacatgtacacacacacacataccatttaagattagacagaagtaatgctcaaaatggagtggcttctgagacatttagtccaagggttcccaaacaggcttttcagtatcagatttctttctgccccattgaaatgctacacaaccttccgcttacagcaggtcacaagggtttcattctacttgaagtaggggccatgtcccatttccacttccttggcttcccattcagtcactgctaggatttgcctagacccctgaggccagacaatgtagaaacttctgctccatgtcacaggtgaggaaacaggctcagagagggacaggctccgaaagtcacatagacaacagtagggctgcggctcaaaccccagcgtctgactccaggtttagtgccttctcagggcatcagtgacactcctcatggccagggtgcccccagtgttgctcacagtctggtatccagggctgagagtgtgctgtgtgctcagactgcctgggttcagtcctggcactgccactttacagtcagtgacctcaggcaggttacttaagctctgcaggcctcagtttcctccttggtggggagggttatgaggcatccttctcatggtaaaccttcagtaaataccagccgttactaggagggtccactcctgcctctccactctccattcatcctgcctgtttcctctgcctgcttcctctgcctgcttctgtggtggtgaattcttcatggctcccaccgcctcctgctgcacccccactcagggcccgcatcaggacccttcctcctattggtttgaactccttggagtcagagggtaatggatagtggagtgagccaggtggcagaatctcagaggccatcccgggcctataagcctcttcaaaatagggccacgtatcaagctttacacacaggagtgaactttcacaagttgttatgactcatactctgtctatagtaagctgttaaccactcccatttggcttatgcctctgtaattattgtactaacttatatcttaaaataaggatattgaaggaatgagccgggagaggctttcctggttgagatatagaagaacaagagttgctctttttccttaaggtctctcctcccacccctgaccttagctcaccagcatgggagaatactatttgactccttgtactctgagacgtggatttcaagatatagcattccaacttcaacggcagcaagaaaagaagcaacagaaggagaagacatcatagcaaacagggatgcatgctgcatttcctaatactcaaacccggaaacgagacttcactcaaggtgaagggagggcaggtcaccacctggtagcactagccctaaattaaggaatgcagaatgtttgtgggattgcccatcataaaaattacaaaatgagtaaggaatgcaggcacagctggccaggtgggtttgtcacaaccatggcagccctttgccccacagccagtacacagaactggtctctccaattccgattgcatatcttctggcacctctgttcctctccctcagctgcccaggatttttctggttctgaccatgttacttcctcttttaaacctgttagcatttcacgactgcctacaggcaacggtctaaatggtcggaaggcccaagcttagcatccgagaccctgacctacctccagccacttcctcctcctctccacttcactggactccccatctccacccagacacctctgttctcccctctgtgtgcctttgcttatgctgtcccctgtgttcctagtgtgtctctggctatcttttaagcttccctccccaacctcattagttctgtggagcccctggaatagagctgacttctccttccctgctgctcccaggctgctcagaactttctggaaagggatgattatctgagttccagcctcaccccagcccccggactctgagtccctcatgtctgcctcccttctttctctctgaccacacagctggtacatagtcagtacagacgcagtcagtgagtggagcacggggcttctctccaggattcctgcccctttgtttatccctagtctcaggactccctactcctggtcttctgcctaaatctgtgcctcttggaagtgaagcctccgttcccagtggggccaggtcctgacccttgggaacttgcaggatccctcccttgggcctctccccgaagcttccagctcaatgctgaccagagcacaggctgcctgtgacagtccttggggtgacctcccttatcaggaaaaatgcagaaaacctattaataccttagccttgtgattgttaatggtcacaaaactcctttagggtcctttggactcagcacctttatggtctcactttgaattttgaacctcccacctccccccatcccccagagtaaggcaaatggtcttctgattgttcctgcagagggaaggctccacaggtaagcacacgatggccaggaagcagagctggagcctgcctgaaaggctgtggagaaatggagggagggctgccctgaggactctgtctggctttgaagttttctactgtttccttttcttctgtgcactgttttaggatgatggggtgatagttccaggctggttgaggatggatttggagacagtcctttgtaccctcagtgagcaagagtatctgtcaccctacctcagcagttgtctctgtcactggtccaagcagctggttcctacacaaggtcaagatcaactggggagaagcagactcctgggtctatcccattagtgaggacagctgcctgggcttatggcctcattggtttggtttctatcttgatcatctctaccatccccccatcccggccttccattttctacctcagctgtcagtgcacagattgatgtgtgtgggaacggagcttgggaggagtggggtagggctggtcctgtcctgtagcctccccttccttcgggcacttggaccctttggagcttgccggggtggggaatgggagtgggaaggccagggagtgtctctgcaccatcactgtttgagtgttgcccctttgctgtgtgccccacctagtctatgtgtgtctctgttctctggggactcaatttgctggtgaattgcttccatggacattgttctgggaaatgccattttttctgctcacccatgactctgtgacaaggaatgacagcttattaggaatttgtttttgcattggaacagtggtcatcagaatgggccccttttcccttgcagctttgacatttgcctctcttttcctcacctctctcccttgcatccacccttttctctttttcttcttttttgttttccttctagcaggggccttttacctttacttgttaatcctgtttgtagcaaagcaagtggaaggaggagttcctctctgatctgcttcttattctccacctaccttctcttctgtactttccgcctcctagagagagagagagagagaggaatgccgacctaactaccgctgccactgctgctgccaccaccgctgccaccaccaccctggtaatgttcacatgtcctcaaatcaacccagagccagggccctgctggtcagggggaggctatgtaaataatcccatgagtgtgccatcctcaggccctggggtctcctaggcaagaccagggcctctgtgggctctctcggaaatgctgaggttgctggaagccagcccgtcatacagggtctgagagtttaacttcttttaaattaaaccacagttgagctcatgctgtgtgtgtataaacttttgtatcctgctttttccttaaattctttatcatcagcatcttcccatgttatttcatagtcttcatcatcatcactttccataccttcatagtagttgatcgtagaattccatcataattaacttgtcttttctctcttagaagtcccttaggtaatgtccaattttccgtgagtgtaagtaataccataatgaacatcttggagtctgaagtttattctgtgttggtttgttccacatttaggatcattttcccaggctagattttcagatgtgggattatgggttcagatatggtttacacatttttatagttcttaatacagatggccaaattgctttctgaaagagaagcttttcttaagtatttttctccaacttgtatcttaaacatcctgaacatgcttagcaccactgtcttgatatatctgcggaaagccacgtctccacttttcagtgtgtcgggccctgggagaggcaggcatcctgcgctggctccttggagctgggtttaaaattgtctcctctggctgggcgtggtggctcacacctgtaatcccagtactttgggaggccgaggtgggcggatcactaggtcaggagatcgagaccatcctggctaacatggtgaaaccccgtctctactaaaaatacaaaaaattagccgggcgtggtggcgggcacttgaaaagtcccagctactcgggaggctgaggcaggagaatgatatgaacccgggaggcggagcttgcagtgagccgagatcgcgccactgcactccagcctgggcgacagagtgagactccattttaaaaaaacaaacaaacaaaacaaaaaaacaaacaaacaaaaactgtctcttctgtgctcacttcacccagaatccctgttgggctcttcaaggagctcagttctctctgaaagcaactttatagcctcagtccagtctgtgttcctgtgtggcaggggtcaagggtatgctcactcttgagagtggtgtctttggttgaccaagaaccactcccatagcctggtccctaacccttgaaggcccatctctctcactcactggggtgaagagtttaaatctcagatccaagttttgttgagagctctgagctaccatattgctatggttaacaatagttaacaatgttaacaatggttaactatggttaacaatagttaacaatgtttaacaactagagcccagctgggtgtggtggcatgtgctaacagtcccagcttctcaagaggctgaggtgagaagattgctggagtccaggagctcaaggccagcctgggcaacatggcgagaccctgtctcccctgcaaaaaaacaacaacaacaaaagcaaaactagagcccaactgctgtgaactcatggctgagtagatattattagccctccacaaactcagcatttgtataatcccaggctgtttccagtaattctctggggatcatctcccagcctgtccactgttccaggatccacacttaggcctataggaatgccccgtcagagcttctgctgccgctgatctgttactgtttcatgcaacccactcggcctagttccttcctcttactgtctcagtgggcacagaaaagcatacagagggtgtttcagcaaacattgccactggctgcagacctgcccccggatctgtcctgttgagagcttagtgctgcgttcttgcatggtggggaggggtgtggctctgtgatgagccagggcatgtgtataggagcaacagtgtctctcttatcacgtagaagttctgactcattgcgagtcttggctttgggttaatggttccagccatgttgctgctgtgtcttttggtgcaggagaggctgggcacagttggtccctaagccattatggataagggatgtgtctgctgatatacacacatggacctgacatccagggaaggcagggtgattggacagaacagttcttccagaagctgttggaacttggacaagagtggcccttggctttctgtagttggtcatctgtcccctgttgcaatcaggggaaggccacacttgccttccttaaccacagttaggattttcttggggattagaccagattctagcacctgtcctgaacctctcgccccgcccctacaaaggctgcttgcaagtgtagtgcacatacacagggagcaggtggggcatggaagtggaagtggagcccctgcctttggcccttgggggaggcactgtctgcttacccacggttgttgcctcataggaatcatacaacagcttcctaactggtctccttgccttcagttggattggggcacaaatccctccttgacatataaaccatggtttaaggctccctgtggcctaaataaagataaagcttaagtatcttaacaagcacctaacccttctccccagcctcggtgatttggctcatcgctgccttcatgtttcattctggcttcactcattcggaatttcttgtagttccttggctgttctcttttccttaccgcctttacaaatgctctcaccatgcatgcttttctctgctcctacagatgccttctctcccagcaccgcctccagagtctatgtctggtcgattctgtctgctgtctccagtccccatcttgtggcagtctctgctcaatcatttggggattttatatgttttctggcctttcttttgggggcctgtcttctccttctaaaagcagccagttgacctagaaggaagggataactgtaactcttgtctaccaacataagattaggcccaccctttaaaagctgcgtctttgaaagggacacctgcacccagcatgctggcttctcttcaccaagcgtgacttcctacgcatttcacaggcctccagaggtccccctgactctcttctgctgtgagaaactctaatcatgtaagccacaggctaattcccttgagccttaaatgtttttagtaatttcccattcatcagagaagcaggatttgggaggaattttgaagcaaacactacagaaggcagagtctccaggtaggatatctaagagacatttggaatggtctgactgttcaagatggatgggaaagcctcttcctgtaatgatagtagccaacatttgttgtcaggcagtggggccccatttttgagatggggtctctgtcacccaggttggagtgcggtggtgctgtcatggctcactgcaacctcagcctccccgggctgggtcttcttaattctgaaaaacccagcttttaaagggtggacctaatcttatgttggtagacaatgttgtctcatttaatacaatgcacatgctctccccataacacaaaagagggaactgaggcctggaggtgtgatgtaccccaagtcacatagctaataaataaagaagccagcattcctgggattaaaaatgcatgtgtctgtcactgtggtgtatttggtgcttgatcaatgtttacttgagcaaatggaggggcagaggtaccgatgagtgtgctcagtgaggagggcaggagtgaagctgggcgtcttcccgcctcttgtgagtggtggggcttggtgagcttgccagggcctgtctttcttatcaaagaaggtgtgtgccccagtgttacagcatttcacccaaagcagcctagaaaatgcttgacttttctgtcattccggggaggacactttcctcctccactgttctgctggcctggtgtacccacggcccctgatagatgatagcacctgctaaagtgcaccatgcccttccgtctcactgcatcccacagatgaggccaggctgggatgagggagaaagggagggatatatagttcaggttattttggaaaactgcctgaccaattttaagtctgggccggacactggggcatctcaccacgttgaaagggccgtggcaccccgggcggtgaaaggggctggaaccaggtctgcttcttgggcttctcctccagggtgccattgctcatgggccttggctgcagaggtgctcattcgtggttccaaaattccaattcctgggagaggaaaaatgcttagttcagtctcagttaggcctctgcttagatcaaacagccaaggccagtaggcccagtcctatggtagagacatggcctcaaagagccctctgctgcagttgttggggagtgtaccaagagaagggagcattgtcctgggctgggcagccctgggggtctagtgcatagatgtagaaaggctctgttggtatacctccctttgcttgttggaaagtgctcaacggggctgaattgtgtttgacagtgtaagtctgggctggggtgagggttgttacaagattgtcaagatgattaaatgaaatgccatttgaaacacttatccatgccttgtgtatggtatccccaccagtgaatattcacagtatattataataattccaacaacttcataattttcatatgcaatttctaaactttgaacttttttttttttttttttttttttgagacagtgtctcgctctgttgcccaggctggagtgcagtggcgcaatcttggctcactgcaacctccacctcccggcttcaagtgattctcctgcctcagcctcctgagtagctaggaatccaggcgcccgccaccacacccagctaatttttgtatttttagtagagacgggctttcgccatgttggccaggctggtctcaaactcctgacctgaggtgatccaccgccttggccttccaaagtgctaggattacatacgtgagccactgtgcccggcaattttttgtgtttttagtagagatggggtttcaccatgttggccaggctggtctcgaactcctgacctcaagtgatctgcccgcctcagcctccctaatgctgggattacaggtgtgagccaccacgcccagcctaaactttgaatttctttgaacccatgacttacacagaattagctgaacgcagaattccaaatcaactcagcctgtgggacagccaaaaaacacagtgtgcctttgggctccttcactcaccacgcggggttagaaaactttgtcagaggctttaaaaaaggagctcttgtgtgtaaaatgtttccttgattctctttctggtgcctctctttctctaagtggtttgcttccccaagttccccacctgagtctgggtggctgtggcacatctgtgcattctgtacgcacacaggcagccttttggagtgccagtttccaggtcttggttttatttatttatttatttatttttttgagatgggggtctcactctgccgcccaggctggagtgcagtggtgccgtcatggctcactgcaacctcaacctccctgggatcagttgagcctcctacctcagcctccagagtactagggaccaccatgcctggcaaatttttgtaattttttgtagaggcagagtctcaccatgttgctcaggctggtctcgagctcctagactcaagtgatctgcccaccttggcctcccaagtgttaggattacaagtgtgagccaccatgcccagcccaggtcatcttttgagggcatggagagaagactttgagcatcccacttttgagattgtgtaccagtcgcaagcccctatgacacactttttccccaaagtagagggctctgactatgttgatcccaagagagatgggaaagagcattgaatgaggattccaaagtattgggccttagttcgtttcctcatgttggtgttgtgaagattctggttaggataacagcatgtgtgcaggaggctttgtgaactgctgagagtgaggcgtggcaatgtcagtgctaggtttgtccttactaacctggggccatgggaattgataagaccagattcccaactctaccccacaatgtgatccctgtggtgacccctcacagggctctttggtcgagcttcccagaagggatcaccatctgccattgtatgttgaaccccattcattcattcattcattcagccaaccagcaactatttgttgagctcttattgtgtgagaagcagtcttcaaggaactgggtgaataaaaaaaacaaaacatcctaaccttcattgagcttacattcttactgaaagaaaacaaataaaacatacatgtaatcctagcactttgggaggccaaggcaggcggatcacttgaggtcaggaatttgaaaccagcctggccaacgtgaaacccatctctactgaaaattaaaaaaaaaaaaaaaaaaaagccgggcatggtggcacatgcctgtaatcccagctactcgcgaggctaaggcaggagaatcgcttgaatcctggaggcagaggttgcagtgagccaagatcataccattatactccagcctcagtgatgaagcaagactccatctcaaaaataaaaaataaaaataaaaatatgcattccctttgcaccagcacacttggtgcctggggacctcgtggttggcaccctgaagcaggtgtccctcttctgtcttgcacaccttgcttctgtcctggtgtgtatggcatggccttctgccctccatggtgagcactgtgagggcagaggttgagttgggtttgctgtatttctcaggtgcctaggtttgtgcttgacaggtagatggaaggcacacaatgtggtcatcaaacctcagtcaaccatataaggaaggtagaagtgaaaagtcccataggtacccaactaatgtcaccagtttcctggatacctttcctggagtttatttatagtgtgtataaataaatgatgtatgtgtttaaatgcctttttcacctttccttttagagctgcctctttttaacagttccattccattgtatggatgtactatgatttattgaaccagttccctactgattattctgttttttgcagtcttttgttatgatgaacattccacagtgacaatgttgttcatagtcattcacacacatgcaagtccttctgcaggatatatttctagaggggaattgctgactcagaggttttggtactctgtgttgattgtagagtgacggcagaaaagtgaggcccaagagtttcctagtgaccatgtgtagtggacaagtcaccagtccctgtgagtgtttggcccaaaggctttaaggcatttgatatcactgtttttgtttctgcaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcaggtaagagatactcagtcagaatctgtggtaaacatgtctctctcatgtgttgactaggaaatgcagtcctggcagctcaagagtgcctctttaagctctggagcagaatgcctcctctgagaaatgggtgctttgtattagttgagatggaaagaagagaccagaaatgcctgtagtctctgcacatccagacaaaaacaaattttccccccttttttttttttgtttgttttttgagacagggtctggctctgtcacccaggctggagtgcagtgccgtgatcttggctcaccgcaacctctgcctcccgggttcatgccatcctgtcacctcagcctcctgagtagctgggactacaaacacttgccaccatgcgcagctaatttttgtatattttgtagagatggggttttgctgtattgcccagtctggtctcgaactcctgagctcaagcaatccatctgccttggcctctcgaagtgctggattataggcatgtggcaccatgcctggcctaagaacagtttttagcatttgggaggggctctcatctttaagctccaaatgatactgtattttcttgcttttttctttctcttgccccacaagttttggaaagtaaattggaatagttttcccccactgaattatttagcttgtatacctcagcagatgttccttggcctgttttgttttgtttttgagacagggtcttgctctgtcacccaggctggagtgcagtgacacaatcatggctcactgcagccttgactgcctgggctcaatccatcctgcagcctcagcctcctgagtagttgggactacaggcatgagccagcatgtccagctaattttttatttttagtggagatgaggtctggctatgttgcccaagctgggcttgaactcttgggctcaagtgatcctctcacctcagccttccaaagcattgggattacaggtgtgaaccactgctcccgcccttggccctataagaaggaatgtgattctgttttccagcagggcacaaacttctgcttaaatacaaagcccaaatttttccaccaaaatgcccctagtgaagtggccagcccagatgcccgactagcgtattatccaaagcatattgtcattggtggaaaatggccttatagtccattgttttgtcttaaaagtaaatatataaataaacttgtatattgtttcctaattccgtgtttatattaacataaaagtgttttaaattacctgtcagtggccaggtgcagtggctcgtgcctgtaatcgcagcactttgggaggccgaggcgggcagatcacctgaggtcaggagttcgagaccagcctgaccagcatggtgaaaccctgtctctactaaaaatacaaaaattagccaggtgtggtggcaggtgcctgtaatcccagctactcgggaagctgaggcaggagaattgcttgaacccgggaggcagaggttgcagtgagttgagatcgcgccattgaacttcaacttgggcaacagagcaagactctgtctcagagaaagaaaaaaaaaaacctatcagttgaataacaaaaccctttccttccttgctttaagtgaatctgaagatccaggagctgtgctgcaggtaccctctatgttgggtacccctggtttaggctgactagtacagtgtggttggctcatgtagacagcagaccctttattttagatacaactttttttctttttcttttattttttttgagacagagtcttgcttgtcacccagcctggagtgcagtggcgtgatcatggctcactatagccttaaactccctggctcaagtgatcctctcacctcggctttcctagtagctgggaccacaggtgtgggccagcacccctggctgatttaaaaaaaaaaaaatttttttttttagagatgtctcactatgttacccaggctggtcttgaactcctgggggctcaagcaatcctcctgctttgacctcccaaagtgctgggatgacaggcatgaactactgcacctgctgagatgcaacagctttctgtcagactcattttattctcatcatttcttcctgtcctcccttgctgggagcatgagagctgtgatgggaatataggaatgtatgaagtccttctcccagatcaaaaatcctaacttcttgtcttaaagggaggaaaatttgaatgtaaccttacttttagactcttcagaaatccttctatacccttccgtccccgctttcacccttcctccctctccgtgtgtgtatcttcttctcttgaaacacacaggtttataccctgacccctcttgattcatcccttgaagcacagtggtgaacaaggaaggggcccgtgatgccctaattctttgccacagcaccatgtttgtttcacaaggagcctggcaggtttgggcttggggcagataggggagagaaagcagcagagacagcaaaaccaaatcatgtcagcttggcatgtacttccctctgaaatagctaagaatccatttctgtaaaagcactgattatcagaaaaccttattggcctggccacctttggttcaaaccctcacattaataatgtggacagtagtatgaggtgtgccaaaggtggatgactcagcacctaagtgatgacacctaattacgaataggttcattaaagcagaccccctggggacctttgcttgaggatccttacagtcagaattcctgaatatatttgaaaataataattgcatctttattttcatatgttctgtatggtttggctgacttccccctcaaagtctgagttagagttttccttaatttatgtgatgggtttggtctttttggattccagaaagagctgggtgtggtttggagctgcactcagagtcacacaaaaccacagcctttagagaacccacaggaaggctttggggcacgtcctgattcttgacatttctcatcagtgctgactttgtatcccttaggagttcacaattcataaccactgaaatattaaaatacaaaaagttttggaaggatgagagcccagatgctctactacttgaaaatatgttaaaacataagttcatcattatacattttgctaaatcaggataaagtctgaagtttcaaagaagttttattttagcaaattttcagaaacactgcctcaactgttagggccagtgttctagtcagtatgcctttggaagcatgaaagctggattggtcgataggatgggtgtggaaggggggctgtgactgggtgggtacagagaggctctgaaacaatctcagattccaggagttcctggataaggacttcatgtgcgggaacagagcacaggagaagcagattcctgagccactcaggaagaactgggcctaggcctgctcttgtcactgactggctttctacataaccacagaaacagcactgtgttgtagaaagaggaagatcatactttttgatatctgtgtctaatttaaggtcatctgagccctgatagaaaagcaaaacagacaaaacccttgtaactgctccctcccaccccacccaccatcaaaaaagctttagagaggctggacatggtggctcttgcctgtgatcccagcactttgggaggctaaggtgggtggatcacctgaggtcaggagttcgagaccagcctgaccaatatggtgaaaccccatctgtactaaaaatacaaaaattagccaggtgtggtggcacacgcctgtagtcccagctacttgggaggctgagacaggagaattacttgaaaacctgggaggcggaggttgcagtgagccgagatcacgccattgtactccagcctgggctacagagcgagactccttcaaaaaaaaaaaaaaaaaaagatccggtttggtgtcttacaactgtaatcccagcactttgggaggccgaggccggtggatcacgaggttaagagatcaagaccatcctgaccaacatggtgaaaccctgtctctactaaaaattagctgggcgtggtggcaggcgcctgtagtcccagctcctcaggaggctgaggcagaagaatcgcttgaacccgggaggcggaagttgcagtgagcctagatcgcgcccctgcactccagcctggcaacagagcaagactacgtctcaaaaaaaaaataaataaaaactctagagaagcaaaaagaataactttaaaagtgtttatgttctcagcaagctttattttggggatgtcagaacttaactaaccactgctccttctgtgtgtatgtttttcctccagcctaccttatgttcagtattttggaggtgtctctgctctaagtaaacaacagtttctaaccatcaatggatttcctaataattattggggctggggaggagaagatgatgacatttttaacaggtaatggtcataacttagatatctttctcctctgtcaaccttcacttccagttttttaaccaatgcttggttgttccccaaggactgaccctcagatgggatgcacccctagtcagcccacattcttaggtgtggcttcctacaggtcctgcaggtgctaaaagggatctgtaggaaaatgagtttctgagatttttgtattggcctggaaaaatgtcaaatgggaaccaagtgacggggcaagtttactttgacttgctgcatgccgttttgtactcaaggagtaaaccaatgtcctttgtaaaaatccctcctttcattatggtcccctttcactgtgaaacaagtttccttgagcagaatcctaactgtcttcacagaagctttgtgttatatttttattttggagtattttcacatatacaaaagagatactgtagtataataaacctttgaggacctatccagccccagcaaccattatggcctggtcagttctgtcccatccacatcctggggctctttttaagctggtaaatcattatgatgtgggttgtcatttacagtggtaaaaaacatctatcagtagcatttgaaagaacattctgctcagtcctctggctgtagaggcttcaaccccaccagccaccgatgagcaccttctccctccaggagccagtctgagctcattactgagtttaatatcagaatacaccctggtgcagcctttctaaattgcagtaccagttaacagaaggtgtctgtcagagcaacacccaagtcattcaagttaccattgtgtgcaaacttaacagagacccacgtcttcaatataagccttgaaggaaactccagttttagtatgtagatggggtatcaagtgtgtgcacattgaacatctgctgcatacagagcactgtgccaggcaggcccaggacactgaaaacctggacatagggtccagacagaagcaagcctgcttccacagaggcactcctgggcagacactctggactgatatgacagtgtgcagggccgacaggataccacaggtctgaatggtcagaacagctggggagggagggagcatccgcaggcatctagtcccatgctaacgcagtggcactagaaggatgggtggtgtgtggagcaactttcttgaaagataaaggacctaacactttctatgcaccacttactgtgtgccaggcaaggccaggaatgtttaagtggtctgggatcagccagttctgcctcttaactaactttgctgtcctgctctccaggctttcattttggtcctcattccttttccttggaccaacacagaatcctccaccctgttctggctgcctctagtcttgttctcagccctccatttgtttttttctgccttttcccacatgttctgaagccctccattcgtatactactttccagagacttccccatggctaaaagcattttggaaatactgtatattaggcccctttcagatactggcaaccgtttgtgggatgctctgagaaggcctctgtgacttagcctggcccttttcagcccatcacctgccacgtcctaccccagacccttgtcaccagtccccaggagcttacgttgctccctgagggcactaggcttgctctcacttccatgcctttgcctgtgccatcctggctgcccaaaatgctatggcagatacctgttcatcctcaactgggctctgcctaggcttgctccagcagaggttacaaactctatgcttcttcctctgtgtctccaacctcatcttcctcttctcacctccatcctggccctaaaggccctatgtttgaagcattcacactgtatattctgtggggcacacggccccagtgtctggcacatggtagtcaacaccacaaaccgcagaaccagttgtaaaaggacatggagtcggaatgtgagttttaaccagggtcatgctgggctgggttctggcatgatgctgggttgtgggctgagtgagaacagcaagggtgatggtggatggagcaacagtcttgcagccggggctctcaggccaagtgtatggcagctctgtgataatgactttccctttactctttgcagattagtttttagaggcatgtctatatctcgcccaaatgctgtggtcgggaggtgtcgcatgatccgccactcaagagacaagaaaaatgaacccaatcctcagaggtgcattctttgtttattcatactccttccccctttaggatgaggtaggctgcaggtccgaggctctgggcctagagggaaattgaggtggtcaggttacagtggagagggaggaggaagtacgtgtgatgatttcttcttaagatttttgttttaagacaatctccttgtgctcttttccttgtaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcaccccagagtcagaactgtacacatcccaaaatttggtggccgtggaacacattcccggtgatagaattgctaaattgtcgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaactgcaggtggtttctgtttgccaggtgtaagggttgtcatggctgtgggatggggtggggacagggtcattccctggtctgtgacccatacaaatacacatgcctccctggaatcagacatttccccatctgaacttcattctcttatctgtaaaatgggaataataacacatagggacttttttgaggcttaaaagtgacgatatatgtaaaacaatgactaatgcctcacaagtactcactacatagtagctagtgccatttcaaagtagaatttttttcccctagcagttcttgggccacattctgctattttcaacagataccaggatcattcagatgtagatctcagggccatttgcaccaggtgctcacagtgtaacttgaagggaattatccaaaatgaggtttcttgtcagtctcaggaaatgtaaccataagctctaaaaggtcttagtttttacccaggtgcctcctccttggtggccctgggtcaggctggttggattgaattggcactcctgaagaagggctgcaggaaaccagtgagcaggagagccacccttggcagggagctgcaggccctgcctgcatgtcactgctggagggatccctggtgacctcaggcctgtgcaaaggtggcctggggttcagatctggccttcaaacaggacaactctggtcctttggacaaaatgctgccttagagggtctgacaaaattaaaaacaaacaaaaaaaaacctgtttctttccttctcacacaccaccactcacaacacttcagttctgcccctagatatgtagggatttctccccaccaacaagcagttttctagtggacactagctgggtgtcctacagtttaactcaattctgacactgtctgcctggagatagcaacggatcccacaggttgagggctcagtctcacaagactgcctccactgcagatgccagtcacaagtagttggttgtgacctatgctttacaaaaatgttttttggatacagggccttgctgtgtcacccaggctggcctgaaactcctgggctcacacaatcctcccgccacaacttagaagtagctgagctgcaggtttataccactcacccagctatagttgtgacctatacttctgaccaaccagctataaattggggtttctatgagcctcttcttgggtttaatttgctaggtcagcttacagaactcagtgtaacacttaacatttactggtcttattataagtgatattagaaaggatactgatgaagaaccggatggagagatgcatagggcaaggcatgggggagggggagagaagcttccatgccctctccaggggctccaccctccagacacctccacgtgttcagctatctggaagctcatctgaccctgtccttctggtttttatggaagcttcatcacataggcctgatagactacatcatcggccattgccagtcagctcaaccttcagcccttttccccttcctgaaggatgggagtgggactgaaagtgccaaccttctcatcatggcttggtctttctggtgaccagtccccatccaggagttcactgagaatcatttcattaaaacaaaagacgttcctatcacccgggaaattccaagggattagaagctctgtcaggaaccagggtcaagcaccaaatattagaacaaaagattctcctagcataaatattagaacaaaagattctcctagcataaatattagaacaaaaaattctcctattgctcaggaaattataagagttttaggggctctgtaccaggaacccagcgcagaggccaaatatatatattttattatctcacagtgccacacaggactttgcaagctgtcaggtctgagtgagatggagcacaccagtgaaaggttaagttcaccctttcactgatgtgctccacttcactgagacacatatccacacagacacacagagacacacacatccacccagacgcacgca

SEQ ID NO: 2 - RNA, 19 nt, Homo sapiens
  source 1..19: mol_type = mRNA
cttgaatttcctatgtatt

SEQ ID NO: 3 - RNA, 19 nt, Homo sapiens
  source 1..19: mol_type = mRNA
aatggatttcctaataatt

SEQ ID NO: 4 - RNA, 19 nt, Homo sapiens
  source 1..19: mol_type = mRNA
tcagtattttggaggtgtc

SEQ ID NO: 5 - RNA, 19 nt, Homo sapiens
  source 1..19: mol_type = mRNA
tggatttcctaataattat

SEQ ID NO: 6 - RNA, 19 nt, Homo sapiens
  source 1..19: mol_type = mRNA
tgaatttcctatgtatttt

SEQ ID NO: 7 - RNA, 19 nt, Homo sapiens
  source 1..19: mol_type = mRNA
gctggatgtacagagatac

SEQ ID NO: 8 - RNA, 19 nt, Homo sapiens
  source 1..19: mol_type = mRNA
ccaaagtgccttaaaagaa

SEQ ID NO: 9 - RNA, 19 nt, Homo sapiens
  source 1..19: mol_type = mRNA
tatgtaaacttgaatttcc

SEQ ID NO: 10 - RNA, 19 nt, Homo sapiens
  source 1..19: mol_type = mRNA
ggcacatttccgttgcaat

SEQ ID NO: 11 - RNA, 19 nt, Homo sapiens
  source 1..19: mol_type = mRNA
atgtaaacttgaatttcct

SEQ ID NO: 12 - RNA, 19 nt, Homo sapiens
  source 1..19: mol_type = mRNA
atggatttcctaataatta

SEQ ID NO: 13 - RNA, 19 nt, Homo sapiens
  source 1..19: mol_type = mRNA
tgtctctgctctaagtaaa

SEQ ID NO: 14 - RNA, 19 nt, Homo sapiens
  source 1..19: mol_type = mRNA
caaagtgccttaaaagaaa

SEQ ID NO: 15 - RNA, 19 nt, Homo sapiens
  source 1..19: mol_type = mRNA
tgaatgtgccttttaatta

SEQ ID NO: 16 - RNA, 19 nt, Homo sapiens
  source 1..19: mol_type = mRNA
acttgaatttcctatgtat

SEQ ID NO: 17 - RNA, 19 nt, Homo sapiens
  source 1..19: mol_type = mRNA
ctgacttttccaaagtgcc

SEQ ID NO: 18 - RNA, 19 nt, Homo sapiens
  source 1..19: mol_type = mRNA
caatggatttcctaataat

SEQ ID NO: 19 - RNA, 19 nt, Homo sapiens
  source 1..19: mol_type = mRNA
ttcagtattttggaggtgt

SEQ ID NO: 20 - RNA, 19 nt, Homo sapiens
  source 1..19: mol_type = mRNA
cctgacttttccaaagtgc

SEQ ID NO: 21 - RNA, 19 nt, Homo sapiens
  source 1..19: mol_type = mRNA
ggatttcctaataattatt

SEQ ID NO: 22 - RNA, 19 nt, synthetic construct
  source 1..19: mol_type = other RNA
aatacataggaaattcaag

SEQ ID NO: 23 - RNA, 19 nt, synthetic construct
  source 1..19: mol_type = other RNA
aattattaggaaatccatt

SEQ ID NO: 24 - RNA, 19 nt, synthetic construct
  source 1..19: mol_type = other RNA
gacacctccaaaatactga

SEQ ID NO: 25 - RNA, 19 nt, synthetic construct
  source 1..19: mol_type = other RNA
ataattattaggaaatcca

SEQ ID NO: 26 - RNA, 19 nt, synthetic construct
  source 1..19: mol_type = other RNA
aaaatacataggaaattca

SEQ ID NO: 27 - RNA, 19 nt, synthetic construct
  source 1..19: mol_type = other RNA
gtatctctgtacatccagc

SEQ ID NO: 28 - RNA, 19 nt, synthetic construct
  source 1..19: mol_type = other RNA
ttcttttaaggcactttgg

SEQ ID NO: 29 - RNA, 19 nt, synthetic construct
  source 1..19: mol_type = other RNA
ggaaattcaagtttacata

SEQ ID NO: 30 - RNA, 19 nt, synthetic construct
  source 1..19: mol_type = other RNA
attgcaacggaaatgtgcc

SEQ ID NO: 31 - RNA, 19 nt, synthetic construct
  source 1..19: mol_type = other RNA
aggaaattcaagtttacat

SEQ ID NO: 32 - RNA, 19 nt, synthetic construct
  source 1..19: mol_type = other RNA
taattattaggaaatccat

SEQ ID NO: 33 - RNA, 19 nt, synthetic construct
  source 1..19: mol_type = other RNA
tttacttagagcagagaca

SEQ ID NO: 34 - RNA, 19 nt, synthetic construct
  source 1..19: mol_type = other RNA
tttcttttaaggcactttg

SEQ ID NO: 35 - RNA, 19 nt, synthetic construct
  source 1..19: mol_type = other RNA
taattaaaaggcacattca

SEQ ID NO: 36 - RNA, 19 nt, synthetic construct
  source 1..19: mol_type = other RNA
atacataggaaattcaagt

SEQ ID NO: 37 - RNA, 19 nt, synthetic construct
  source 1..19: mol_type = other RNA
ggcactttggaaaagtcag

SEQ ID NO: 38 - RNA, 19 nt, synthetic construct
  source 1..19: mol_type = other RNA
attattaggaaatccattg

SEQ ID NO: 39 - RNA, 19 nt, synthetic construct
  source 1..19: mol_type = other RNA
acacctccaaaatactgaa

SEQ ID NO: 40 - RNA, 19 nt, synthetic construct
  source 1..19: mol_type = other RNA
gcactttggaaaagtcagg

SEQ ID NO: 41 - RNA, 19 nt, synthetic construct
  source 1..19: mol_type = other RNA
aataattattaggaaatcc

SEQ ID NO: 42 - RNA, 19 nt, synthetic construct
  source 1..19: mol_type = other RNA
cttgaatttcctatgtatt

SEQ ID NO: 43 - RNA, 19 nt, synthetic construct
  source 1..19: mol_type = other RNA
aatggatttcctaataatt

SEQ ID NO: 44 - RNA, 19 nt, synthetic construct
  source 1..19: mol_type = other RNA
tcagtattttggaggtgtc

SEQ ID NO: 45 - RNA, 19 nt, synthetic construct
  source 1..19: mol_type = other RNA
tggatttcctaataattat

SEQ ID NO: 46 - RNA, 19 nt, synthetic construct
  source 1..19: mol_type = other RNA
tgaatttcctatgtatttt

SEQ ID NO: 47 - RNA, 19 nt, synthetic construct
  source 1..19: mol_type = other RNA
gctggatgtacagagatac

SEQ ID NO: 48 - RNA, 19 nt, synthetic construct
  source 1..19: mol_type = other RNA
ccaaagtgccttaaaagaa

SEQ ID NO: 49 - RNA, 19 nt, synthetic construct
  source 1..19: mol_type = other RNA
tatgtaaacttgaatttcc

SEQ ID NO: 50 - RNA, 19 nt, synthetic construct
  source 1..19: mol_type = other RNA
ggcacatttccgttgcaat

SEQ ID NO: 51 - RNA, 19 nt, synthetic construct
  source 1..19: mol_type = other RNA
atgtaaacttgaatttcct

SEQ ID NO: 52 - RNA, 19 nt, synthetic construct
  source 1..19: mol_type = other RNA
atggatttcctaataatta

SEQ ID NO: 53 - RNA, 19 nt, synthetic construct
  source 1..19: mol_type = other RNA
tgtctctgctctaagtaaa

SEQ ID NO: 54 - RNA, 19 nt, synthetic construct
  source 1..19: mol_type = other RNA
caaagtgccttaaaagaaa

SEQ ID NO: 55 - RNA, 19 nt, synthetic construct
  source 1..19: mol_type = other RNA
tgaatgtgccttttaatta

SEQ ID NO: 56 - RNA, 19 nt, synthetic construct
  source 1..19: mol_type = other RNA
acttgaatttcctatgtat

SEQ ID NO: 57 - RNA, 19 nt, synthetic construct
  source 1..19: mol_type = other RNA
ctgacttttccaaagtgcc

SEQ ID NO: 58 - RNA, 19 nt, synthetic construct
  source 1..19: mol_type = other RNA
caatggatttcctaataat

SEQ ID NO: 59 - RNA, 19 nt, synthetic construct
  source 1..19: mol_type = other RNA
ttcagtattttggaggtgt

SEQ ID NO: 60 - RNA, 19 nt, synthetic construct
  source 1..19: mol_type = other RNA
cctgacttttccaaagtgc

SEQ ID NO: 61 - RNA, 19 nt, synthetic construct
  source 1..19: mol_type = other RNA
ggatttcctaataattatt

SEQ ID NO: 62 - RNA, 19 nt, synthetic construct
  source 1..19: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = um
  modified_base 4: mod_base = OTHER; note = 2'-Fluoro-adenosine
  modified_base 5: mod_base = cm
  modified_base 6: mod_base = OTHER; note = 2'-Fluoro-adenosine
  modified_base 7: mod_base = um
  modified_base 8: mod_base = OTHER; note = 2'-Fluoro-adenosine
  modified_base 9: mod_base = gm
  modified_base 10: mod_base = OTHER; note = 2'-Fluoro-guanosine
  modified_base 11: mod_base = OTHER; note = 2'-O-methyl-adenosine
  modified_base 12: mod_base = OTHER; note = 2'-Fluoro-adenosine
  modified_base 13: mod_base = OTHER; note = 2'-O-methyl-adenosine
  modified_base 14: mod_base = OTHER; note = 2'-Fluoro-uridine
  modified_base 15: mod_base = um
  modified_base 16: mod_base = OTHER; note = 2'-Fluoro-cytidine
  modified_base 17: mod_base = OTHER; note = 2'-O-methyl-adenosine
  modified_base 17^18: mod_base = OTHER; note = Phosphorothioate bond
  modified_base 18: mod_base = OTHER; note = 2'-Fluoro-adenosine
  modified_base 18^19: mod_base = OTHER; note = Phosphorothioate bond
  modified_base 19: mod_base = gm
aatacataggaaattcaag

SEQ ID NO: 63 - RNA, 19 nt, synthetic construct
  source 1..19: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = um
  modified_base 4: mod_base = OTHER; note = 2'-Fluoro-uridine
  modified_base 5: mod_base = OTHER; note = 2'-O-methyl-adenosine
  modified_base 6: mod_base = OTHER; note = 2'-Fluoro-uridine
  modified_base 7: mod_base = um
  modified_base 8: mod_base = OTHER; note = 2'-Fluoro-adenosine
  modified_base 9: mod_base = gm
  modified_base 10: mod_base = OTHER; note = 2'-Fluoro-guanosine
  modified_base 11: mod_base = OTHER; note = 2'-O-methyl-adenosine
  modified_base 12: mod_base = OTHER; note = 2'-Fluoro-adenosine
  modified_base 13: mod_base = OTHER; note = 2'-O-methyl-adenosine
  modified_base 14: mod_base = OTHER; note = 2'-Fluoro-uridine
  modified_base 15: mod_base = cm
  modified_base 16: mod_base = OTHER; note = 2'-Fluoro-cytidine
  modified_base 17: mod_base = OTHER; note = 2'-O-methyl-adenosine
  modified_base 17^18: mod_base = OTHER; note = Phosphorothioate bond
  modified_base 18: mod_base = OTHER; note = 2'-Fluoro-uridine
  modified_base 18^19: mod_base = OTHER; note = Phosphorothioate bond
  modified_base 19: mod_base = um
aattattaggaaatccatt

SEQ ID NO: 64 - RNA, 19 nt, synthetic construct
  source 1..19: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = cm
  modified_base 4: mod_base = OTHER; note = 2'-Fluoro-adenosine
  modified_base 5: mod_base = cm
  modified_base 6: mod_base = OTHER; note = 2'-Fluoro-cytidine
  modified_base 7: mod_base = um
  modified_base 8: mod_base = OTHER; note = 2'-Fluoro-cytidine
  modified_base 9: mod_base = cm
  modified_base 10: mod_base = OTHER; note = 2'-Fluoro-adenosine
  modified_base 11: mod_base = OTHER; note = 2'-O-methyl-adenosine
  modified_base 12: mod_base = OTHER; note = 2'-Fluoro-adenosine
  modified_base 13: mod_base = OTHER; note = 2'-O-methyl-adenosine
  modified_base 14: mod_base = OTHER; note = 2'-Fluoro-uridine
  modified_base 15: mod_base = OTHER; note = 2'-O-methyl-adenosine
  modified_base 16: mod_base = OTHER; note = 2'-Fluoro-cytidine
  modified_base 17: mod_base = um
  modified_base 17^18: mod_base = OTHER; note = Phosphorothioate bond
  modified_base 18: mod_base = OTHER; note = 2'-Fluoro-guanosine
  modified_base 18^19: mod_base = OTHER; note = Phosphorothioate bond
  modified_base 19: mod_base = OTHER; note = 2'-O-methyl-adenosine
gacacctccaaaatactga

SEQ ID NO: 65 - RNA, 19 nt, synthetic construct
  source 1..19: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-Fluoro-adenosine
  modified_base 5: mod_base = um
  modified_base 6: mod_base = OTHER; note = 2'-Fluoro-uridine
  modified_base 7: mod_base = OTHER; note = 2'-O-methyl-adenosine
  modified_base 8: mod_base = OTHER; note = 2'-Fluoro-uridine
  modified_base 9: mod_base = um
  modified_base 10: mod_base = OTHER; note = 2'-Fluoro-adenosine
  modified_base 11: mod_base = gm
  modified_base 12: mod_base = OTHER; note = 2'-Fluoro-guanosine
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-uridine
  modified_base 17: mod_base = cm
  modified_base 17^18: mod_base = OTHER; note = Phosphorothioate bond
  modified_base 18: mod_base = OTHER; note = 2'-Fluoro-cytidine
  modified_base 18^19: mod_base = OTHER; note = Phosphorothioate bond
  modified_base 19: mod_base = OTHER; note = 2'-O-methyl-adenosine
ataattattaggaaatcca

SEQ ID NO: 66 - RNA, 19 nt, synthetic construct
  source 1..19: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-Fluoro-adenosine
  modified_base 5: mod_base = um
  modified_base 6: mod_base = OTHER; note = 2'-Fluoro-adenosine
  modified_base 7: mod_base = cm
  modified_base 8: mod_base = OTHER; note = 2'-Fluoro-adenosine
  modified_base 9: mod_base = um
  modified_base 10: mod_base = OTHER; note = 2'-Fluoro-adenosine
  modified_base 11: mod_base = gm
  modified_base 12: mod_base = OTHER; note = 2'-Fluoro-guanosine
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-uridine
  modified_base 17: mod_base = um
  modified_base 17^18: mod_base = OTHER; note = Phosphorothioate bond
  modified_base 18: mod_base = OTHER; note = 2'-Fluoro-cytidine
  modified_base 18^19: mod_base = OTHER; note = Phosphorothioate bond
  modified_base 19: mod_base = OTHER; note = 2'-O-methyl-adenosine
aaaatacataggaaattca

SEQ ID NO: 67 - RNA, 19 nt, synthetic construct
  source 1..19: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-Fluoro-uridine
  modified_base 5: mod_base = cm
  modified_base 6: mod_base = OTHER; note = 2'-Fluoro-uridine
  modified_base 7: mod_base = cm
  modified_base 8: mod_base = OTHER; note = 2'-Fluoro-uridine
  modified_base 9: mod_base = gm
  modified_base 10: mod_base = OTHER; note = 2'-Fluoro-uridine
  modified_base 11: mod_base = OTHER; note = 2'-O-methyl-adenosine
  modified_base 12: mod_base = OTHER; note = 2'-Fluoro-cytidine
  modified_base 13: mod_base = OTHER; note = 2'-O-methyl-adenosine
  modified_base 14: mod_base = OTHER; note = 2'-Fluoro-uridine
  modified_base 15: mod_base = cm
  modified_base 16: mod_base = OTHER; note = 2'-Fluoro-cytidine
  modified_base 17: mod_base = OTHER; note = 2'-O-methyl-adenosine
  modified_base 17^18: mod_base = OTHER; note = Phosphorothioate bond
  modified_base 18: mod_base = OTHER; note = 2'-Fluoro-guanosine
  modified_base 18^19: mod_base = OTHER; note = Phosphorothioate bond
  modified_base 19: mod_base = cm
gtatctctgtacatccagc

SEQ ID NO: 68 - RNA, 19 nt, synthetic construct
  source 1..19: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = cm
  modified_base 4: mod_base = OTHER; note = 2'-Fluoro-uridine
  modified_base 5: mod_base = um
  modified_base 6: mod_base = OTHER; note = 2'-Fluoro-uridine
  modified_base 7: mod_base = um
  modified_base 8: mod_base = OTHER; note = 2'-Fluoro-adenosine
  modified_base 9: mod_base = OTHER; note = 2'-O-methyl-adenosine
  modified_base 10: mod_base = OTHER; note = 2'-Fluoro-guanosine
  modified_base 11: mod_base = gm
  modified_base 12: mod_base = OTHER; note = 2'-Fluoro-cytidine
  modified_base 13: mod_base = OTHER; note = 2'-O-methyl-adenosine
  modified_base 14: mod_base = OTHER; note = 2'-Fluoro-cytidine
  modified_base 15: mod_base = um
  modified_base 16: mod_base = OTHER; note = 2'-Fluoro-uridine
  modified_base 17: mod_base = um
  modified_base 17^18: mod_base = OTHER; note = Phosphorothioate bond
  modified_base 18: mod_base = OTHER; note = 2'-Fluoro-guanosine
  modified_base 18^19: mod_base = OTHER; note = Phosphorothioate bond
  modified_base 19: mod_base = gm
ttcttttaaggcactttgg

SEQ ID NO: 69 - RNA, 19 nt, synthetic construct
  source 1..19: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-Fluoro-adenosine
  modified_base 5: mod_base = OTHER; note = 2'-O-methyl-adenosine
  modified_base 6: mod_base = OTHER; note = 2'-Fluoro-uridine
  modified_base 7: mod_base = um
  modified_base 8: mod_base = OTHER; note = 2'-Fluoro-cytidine
  modified_base 9: mod_base = OTHER; note = 2'-O-methyl-adenosine
  modified_base 10: mod_base = OTHER; note = 2'-Fluoro-adenosine
  modified_base 11: mod_base = gm
  modified_base 12: mod_base = OTHER; note = 2'-Fluoro-uridine
  modified_base 13: mod_base = um
  modified_base 14: mod_base = OTHER; note = 2'-Fluoro-uridine
  modified_base 15: mod_base = OTHER; note = 2'-O-methyl-adenosine
  modified_base 16: mod_base = OTHER; note = 2'-Fluoro-cytidine
  modified_base 17: mod_base = OTHER; note = 2'-O-methyl-adenosine
  modified_base 17^18: mod_base = OTHER; note = Phosphorothioate bond
  modified_base 18: mod_base = OTHER; note = 2'-Fluoro-uridine
  modified_base 18^19: mod_base = OTHER; note = Phosphorothioate bond
  modified_base 19: mod_base = OTHER; note = 2'-O-methyl-adenosine
ggaaattcaagtttacata

SEQ ID NO: 70 - RNA, 19 nt, synthetic construct
  source 1..19: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = OTHER; note = 2'-Fluoro-guanosine
  modified_base 5: mod_base = cm
  modified_base 6: mod_base = OTHER; note = 2'-Fluoro-adenosine
  modified_base 7: mod_base = OTHER; note = 2'-O-methyl-adenosine
  modified_base 8: mod_base = OTHER; note = 2'-Fluoro-cytidine
  modified_base 9: mod_base = gm
  modified_base 10: mod_base = OTHER; note = 2'-Fluoro-guanosine
  modified_base 11: mod_base = OTHER; note = 2'-O-methyl-adenosine
  modified_base 12: mod_base = OTHER; note = 2'-Fluoro-adenosine
  modified_base 13: mod_base = OTHER; note = 2'-O-methyl-adenosine
  modified_base 14: mod_base = OTHER; note = 2'-Fluoro-uridine
  modified_base 15: mod_base = gm
  modified_base 16: mod_base = OTHER; note = 2'-Fluoro-uridine
  modified_base 17: mod_base = gm
  modified_base 17^18: mod_base = OTHER; note = Phosphorothioate bond
  modified_base 18: mod_base = OTHER; note = 2'-Fluoro-cytidine
  modified_base 18^19: mod_base = OTHER; note = Phosphorothioate bond
  modified_base 19: mod_base = cm
attgcaacggaaatgtgcc

SEQ ID NO: 71 - RNA, 19 nt, synthetic construct
  source 1..19: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = gm
  modified_base 4: mod_base = OTHER; note = 2'-Fluoro-adenosine
  modified_base 5: mod_base = OTHER; note = 2'-O-methyl-adenosine
  modified_base 6: mod_base = OTHER; note = 2'-Fluoro-adenosine
  modified_base 7: mod_base = um
  modified_base 8: mod_base = OTHER; note = 2'-Fluoro-uridine
  modified_base 9: mod_base = cm
  modified_base 10: mod_base = OTHER; note = 2'-Fluoro-adenosine
  modified_base 11: mod_base = OTHER; note = 2'-O-methyl-adenosine
  modified_base 12: mod_base = OTHER; note = 2'-Fluoro-guanosine
  modified_base 13: mod_base = um
  modified_base 14: mod_base = OTHER; note = 2'-Fluoro-uridine
  modified_base 15: mod_base = um
  modified_base 16: mod_base = OTHER; note = 2'-Fluoro-adenosine
  modified_base 17: mod_base = cm
  modified_base 17^18: mod_base = OTHER; note = Phosphorothioate bond
  modified_base 18: mod_base = OTHER; note = 2'-Fluoro-adenosine
  modified_base 18^19: mod_base = OTHER; note = Phosphorothioate bond
  modified_base 19: mod_base = um
aggaaattcaagtttacat

SEQ ID NO: 72 - RNA, 19 nt, synthetic construct
  source 1..19: mol_type = other RNA
  modified_base 1: mod_base = um
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-Fluoro-uridine
  modified_base 5: mod_base = um
  modified_base 6: mod_base = OTHER; note = 2'-Fluoro-adenosine
  modified_base 7: mod_base = um
  modified_base 8: mod_base = OTHER; note = 2'-Fluoro-uridine
  modified_base 9: mod_base = OTHER; note = 2'-O-methyl-adenosine
  modified_base 10: mod_base = OTHER; note = 2'-Fluoro-guanosine
  modified_base 11: mod_base = gm
  modified_base 12: mod_base = OTHER; note = 2'-Fluoro-adenosine
  modified_base 13: mod_base = OTHER; note = 2'-O-methyl-adenosine
  modified_base 14: mod_base = OTHER; note = 2'-Fluoro-adenosine
  modified_base 15: mod_base = um
  modified_base 16: mod_base = OTHER; note = 2'-Fluoro-cytidine
  modified_base 17: mod_base = cm
  modified_base 17^18: mod_base = OTHER; note = Phosphorothioate bond
  modified_base 18: mod_base = OTHER; note = 2'-Fluoro-adenosine
  modified_base 18^19: mod_base = OTHER; note = Phosphorothioate bond
  modified_base 19: mod_base = um
taattattaggaaatccat

SEQ ID NO: 73 - RNA, 19 nt, synthetic construct
  source 1..19: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = OTHER; note = 2'-Fluoro-adenosine
  modified_base 5: mod_base = cm
  modified_base 6: mod_base = OTHER; note = 2'-Fluoro-uridine
  modified_base 7: mod_base = um
  modified_base 8: mod_base = OTHER; note = 2'-Fluoro-adenosine
  modified_base 9: mod_base = gm
  modified_base 10: mod_base = OTHER; note = 2'-Fluoro-adenosine
  modified_base 11: mod_base = gm
  modified_base 12: mod_base = OTHER; note = 2'-Fluoro-cytidine
  modified_base 13: mod_base = OTHER; note = 2'-O-methyl-adenosine
  modified_base 14: mod_base = OTHER; note = 2'-Fluoro-guanosine
  modified_base 15: mod_base = OTHER; note = 2'-O-methyl-adenosine
  modified_base 16: mod_base = OTHER; note = 2'-Fluoro-guanosine
  modified_base 17: mod_base = OTHER; note = 2'-O-methyl-adenosine
  modified_base 17^18: mod_base = OTHER; note = Phosphorothioate bond
  modified_base 18: mod_base = OTHER; note = 2'-Fluoro-cytidine
  modified_base 18^19: mod_base = OTHER; note = Phosphorothioate bond
  modified_base 19: mod_base = OTHER; note = 2'-O-methyl-adenosine
tttacttagagcagagaca

SEQ ID NO: 74 - RNA, 19 nt, synthetic construct
  source 1..19: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = OTHER; note = 2'-Fluoro-cytidine
  modified_base 5: mod_base = um
  modified_base 6: mod_base = OTHER; note = 2'-Fluoro-uridine
  modified_base 7: mod_base = um
  modified_base 8: mod_base = OTHER; note = 2'-Fluoro-uridine
  modified_base 9: mod_base = OTHER; note = 2'-O-methyl-adenosine
  modified_base 10: mod_base = OTHER; note = 2'-Fluoro-adenosine
  modified_base 11: mod_base = gm
  modified_base 12: mod_base = OTHER; note = 2'-Fluoro-guanosine
  modified_base 13: mod_base = cm
  modified_base 14: mod_base = OTHER; note = 2'-Fluoro-adenosine
  modified_base 15: mod_base = cm
  modified_base 16: mod_base = OTHER; note = 2'-Fluoro-uridine
  modified_base 17: mod_base = um
  modified_base 17^18: mod_base = OTHER; note = Phosphorothioate bond
  modified_base 18: mod_base = OTHER; note = 2'-Fluoro-uridine
  modified_base 18^19: mod_base = OTHER; note = Phosphorothioate bond
  modified_base 19: mod_base = gm
tttcttttaaggcactttg

SEQ ID NO: 75 - RNA, 19 nt, synthetic construct
  source 1..19: mol_type = other RNA
  modified_base 1: mod_base = um
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-Fluoro-uridine
  modified_base 5: mod_base = um
  modified_base 6: mod_base = OTHER; note = 2'-Fluoro-adenosine
  modified_base 7: mod_base = OTHER; note = 2'-O-methyl-adenosine
  modified_base 8: mod_base = OTHER; note = 2'-Fluoro-adenosine
  modified_base 9: mod_base = OTHER; note = 2'-O-methyl-adenosine
  modified_base 10: mod_base = OTHER; note = 2'-Fluoro-guanosine
  modified_base 11: mod_base = gm
  modified_base 12: mod_base = OTHER; note = 2'-Fluoro-cytidine
  modified_base 13: mod_base = OTHER; note = 2'-O-methyl-adenosine
  modified_base 14: mod_base = OTHER; note = 2'-Fluoro-cytidine
  modified_base 15: mod_base = OTHER; note = 2'-O-methyl-adenosine
  modified_base 16: mod_base = OTHER; note = 2'-Fluoro-uridine
  modified_base 17: mod_base = um
  modified_base 17^18: mod_base = OTHER; note = Phosphorothioate bond
  modified_base 18: mod_base = OTHER; note = 2'-Fluoro-cytidine
  modified_base 18^19: mod_base = OTHER; note = Phosphorothioate bond
  modified_base 19: mod_base = OTHER; note = 2'-O-methyl-adenosine
taattaaaaggcacattca

SEQ ID NO: 76 - RNA, 19 nt, synthetic construct
  source 1..19: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-Fluoro-cytidine
  modified_base 5: mod_base = OTHER; note = 2'-O-methyl-adenosine
  modified_base 6: mod_base = OTHER; note = 2'-Fluoro-uridine
  modified_base 7: mod_base = OTHER; note = 2'-O-methyl-adenosine
  modified_base 8: mod_base = OTHER; note = 2'-Fluoro-guanosine
  modified_base 9: mod_base = gm
  modified_base 10: mod_base = OTHER; note = 2'-Fluoro-adenosine
  modified_base 11: mod_base = OTHER; note = 2'-O-methyl-adenosine
  modified_base 12: mod_base = OTHER; note = 2'-Fluoro-adenosine
  modified_base 13: mod_base = um
  modified_base 14: mod_base = OTHER; note = 2'-Fluoro-uridine
  modified_base 15: mod_base = cm
  modified_base 16: mod_base = OTHER; note = 2'-Fluoro-adenosine
  modified_base 17: mod_base = OTHER; note = 2'-O-methyl-adenosine
  modified_base 17^18: mod_base = OTHER; note = Phosphorothioate bond
  modified_base 18: mod_base = OTHER; note = 2'-Fluoro-guanosine
  modified_base 18^19: mod_base = OTHER; note = Phosphorothioate bond
  modified_base 19: mod_base = um
atacataggaaattcaagt

SEQ ID NO: 77 - RNA, 19 nt, synthetic construct
  source 1..19: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = cm
  modified_base 4: mod_base = OTHER; note = 2'-Fluoro-adenosine
  modified_base 5: mod_base = cm
  modified_base 6: mod_base = OTHER; note = 2'-Fluoro-uridine
  modified_base 7: mod_base = um
  modified_base 8: mod_base = OTHER; note = 2'-Fluoro-uridine
  modified_base 9: mod_base = gm
  modified_base 10: mod_base = OTHER; note = 2'-Fluoro-guanosine
  modified_base 11: mod_base = OTHER; note = 2'-O-methyl-adenosine
  modified_base 12: mod_base = OTHER; note = 2'-Fluoro-adenosine
  modified_base 13: mod_base = OTHER; note = 2'-O-methyl-adenosine
  modified_base 14: mod_base = OTHER; note = 2'-Fluoro-adenosine
  modified_base 15: mod_base = gm
  modified_base 16: mod_base = OTHER; note = 2'-Fluoro-uridine
  modified_base 17: mod_base = cm
  modified_base 17^18: mod_base = OTHER; note = Phosphorothioate bond
  modified_base 18: mod_base = OTHER; note = 2'-Fluoro-adenosine
  modified_base 18^19: mod_base = OTHER; note = Phosphorothioate bond
  modified_base 19: mod_base = gm
ggcactttggaaaagtcag

SEQ ID NO: 78 - RNA, 19 nt, synthetic construct
  source 1..19: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = OTHER; note = 2'-Fluoro-adenosine
  modified_base 5: mod_base = um
  modified_base 6: mod_base = OTHER; note = 2'-Fluoro-uridine
  modified_base 7: mod_base = OTHER; note = 2'-O-methyl-adenosine
  modified_base 8: mod_base = OTHER; note = 2'-Fluoro-guanosine
  modified_base 9: mod_base = gm
  modified_base 10: mod_base = OTHER; note = 2'-Fluoro-adenosine
  modified_base 11: mod_base = OTHER; note = 2'-O-methyl-adenosine
  modified_base 12: mod_base = OTHER; note = 2'-Fluoro-adenosine
  modified_base 13: mod_base = um
  modified_base 14: mod_base = OTHER; note = 2'-Fluoro-cytidine
  modified_base 15: mod_base = cm
  modified_base 16: mod_base = OTHER; note = 2'-Fluoro-adenosine
  modified_base 17: mod_base = um
  modified_base 17^18: mod_base = OTHER; note = Phosphorothioate bond
  modified_base 18: mod_base = OTHER; note = 2'-Fluoro-uridine
  modified_base 18^19: mod_base = OTHER; note = Phosphorothioate bond
  modified_base 19: mod_base = gm
attattaggaaatccattg

SEQ ID NO: 79 - RNA, 19 nt, synthetic construct
  source 1..19: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-Fluoro-cytidine
  modified_base 5: mod_base = cm
  modified_base 6: mod_base = OTHER; note = 2'-Fluoro-uridine
  modified_base 7: mod_base = cm
  modified_base 8: mod_base = OTHER; note = 2'-Fluoro-cytidine
  modified_base 9: mod_base = OTHER; note = 2'-O-methyl-adenosine
  modified_base 10: mod_base = OTHER; note = 2'-Fluoro-adenosine
  modified_base 11: mod_base = OTHER; note = 2'-O-methyl-adenosine
  modified_base 12: mod_base = OTHER; note = 2'-Fluoro-adenosine
  modified_base 13: mod_base = um
  modified_base 14: mod_base = OTHER; note = 2'-Fluoro-adenosine
  modified_base 15: mod_base = cm
  modified_base 16: mod_base = OTHER; note = 2'-Fluoro-uridine
  modified_base 17: mod_base = gm
  modified_base 17^18: mod_base = OTHER; note = Phosphorothioate bond
  modified_base 18: mod_base = OTHER; note = 2'-Fluoro-adenosine
  modified_base 18^19: mod_base = OTHER; note = Phosphorothioate bond
  modified_base 19: mod_base = OTHER; note = 2'-O-methyl-adenosine
acacctccaaaatactgaa

SEQ ID NO: 80 - RNA, 19 nt, synthetic construct
  source 1..19: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-Fluoro-cytidine
  modified_base 5: mod_base = um
  modified_base 6: mod_base = OTHER; note = 2'-Fluoro-uridine
  modified_base 7: mod_base = um
  modified_base 8: mod_base = OTHER; note = 2'-Fluoro-guanosine
  modified_base 9: mod_base = gm
  modified_base 10: mod_base = OTHER; note = 2'-Fluoro-adenosine
  modified_base 11: mod_base = OTHER; note = 2'-O-methyl-adenosine
  modified_base 12: mod_base = OTHER; note = 2'-Fluoro-adenosine
  modified_base 13: mod_base = OTHER; note = 2'-O-methyl-adenosine
  modified_base 14: mod_base = OTHER; note = 2'-Fluoro-guanosine
  modified_base 15: mod_base = um
  modified_base 16: mod_base = OTHER; note = 2'-Fluoro-cytidine
  modified_base 17: mod_base = OTHER; note = 2'-O-methyl-adenosine
  modified_base 17^18: mod_base = OTHER; note = Phosphorothioate bond
  modified_base 18: mod_base = OTHER; note = 2'-Fluoro-guanosine
  modified_base 18^19: mod_base = OTHER; note = Phosphorothioate bond
  modified_base 19: mod_base = gm
gcactttggaaaagtcagg

SEQ ID NO: 81 - RNA, 19 nt, synthetic construct
  source 1..19: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = um
  modified_base 4: mod_base = OTHER; note = 2'-Fluoro-adenosine
  modified_base 5: mod_base = OTHER; note = 2'-O-methyl-adenosine
  modified_base 6: mod_base = OTHER; note = 2'-Fluoro-uridine
  modified_base 7: mod_base = um
  modified_base 8: mod_base = OTHER; note = 2'-Fluoro-adenosine
  modified_base 9: mod_base = um
  modified_base 10: mod_base = OTHER; note = 2'-Fluoro-uridine
  modified_base 11: mod_base = OTHER; note = 2'-O-methyl-adenosine
  modified_base 12: mod_base = OTHER; note = 2'-Fluoro-guanosine
  modified_base 13: mod_base = gm
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-adenosine
  modified_base 17: mod_base = um
  modified_base 17^18: mod_base = OTHER; note = Phosphorothioate bond
  modified_base 18: mod_base = OTHER; note = 2'-Fluoro-cytidine
  modified_base 18^19: mod_base = OTHER; note = Phosphorothioate bond
  modified_base 19: mod_base = cm
aataattattaggaaatcc

SEQ ID NO: 82 - RNA, 19 nt, synthetic construct
  source 1..19: mol_type = other RNA
  modified_base 1: mod_base = OTHER; note = 2'-Fluoro-cytidine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = OTHER; note = 2'-Fluoro-uridine
  modified_base 4: mod_base = gm
  modified_base 5: mod_base = OTHER; note = 2'-Fluoro-adenosine
  modified_base 6: mod_base = OTHER; note = 2'-O-methyl-adenosine
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = cm
  modified_base 11: mod_base = OTHER; note = 2'-Fluoro-cytidine
  modified_base 12: mod_base = um
  modified_base 13: mod_base = OTHER; note = 2'-Fluoro-adenosine
  modified_base 14: mod_base = um
  modified_base 15: mod_base = OTHER; note = 2'-Fluoro-guanosine
  modified_base 16: mod_base = um
  modified_base 17: mod_base = OTHER; note = 2'-Fluoro-adenosine
  modified_base 18: mod_base = um
  modified_base 19: mod_base = OTHER; note = 2'-Fluoro-uridine
cttgaatttcctatgtatt

SEQ ID NO: 83 - RNA, 19 nt, synthetic construct
  source 1..19: mol_type = other RNA
  modified_base 1: mod_base = OTHER; note = 2'-Fluoro-adenosine
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = OTHER; note = 2'-Fluoro-uridine
  modified_base 4: mod_base = gm
  modified_base 5: mod_base = OTHER; note = 2'-Fluoro-guanosine
  modified_base 6: mod_base = OTHER; note = 2'-O-methyl-adenosine
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = cm
  modified_base 11: mod_base = OTHER; note = 2'-Fluoro-cytidine
  modified_base 12: mod_base = um
  modified_base 13: mod_base = OTHER; note = 2'-Fluoro-adenosine
  modified_base 14: mod_base = OTHER; note = 2'-O-methyl-adenosine
  modified_base 15: mod_base = OTHER; note = 2'-Fluoro-uridine
  modified_base 16: mod_base = OTHER; note = 2'-O-methyl-adenosine
  modified_base 17: mod_base = OTHER; note = 2'-Fluoro-adenosine
  modified_base 18: mod_base = um
  modified_base 19: mod_base = OTHER; note = 2'-Fluoro-uridine
aatggatttcctaataatt

SEQ ID NO: 84 - RNA, 19 nt, synthetic construct
  source 1..19: mol_type = other RNA
  modified_base 1: mod_base = OTHER; note = 2'-Fluoro-uridine
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = OTHER; note = 2'-Fluoro-adenosine
  modified_base 4: mod_base = gm
  modified_base 5: mod_base = OTHER; note = 2'-Fluoro-uridine
  modified_base 6: mod_base = OTHER; note = 2'-O-methyl-adenosine
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = um
  modified_base 11: mod_base = OTHER; note = 2'-Fluoro-guanosine
  modified_base 12: mod_base = gm
  modified_base 13: mod_base = OTHER; note = 2'-Fluoro-adenosine
  modified_base 14: mod_base = gm
  modified_base 15: mod_base = OTHER; note = 2'-Fluoro-guanosine
  modified_base 16: mod_base = um
  modified_base 17: mod_base = OTHER; note = 2'-Fluoro-guanosine
  modified_base 18: mod_base = um
  modified_base 19: mod_base = OTHER; note = 2'-Fluoro-cytidine
tcagtattttggaggtgtc

SEQ ID NO: 85 - RNA, 19 nt, synthetic construct
  source 1..19: mol_type = other RNA
  modified_base 1: mod_base = OTHER; note = 2'-Fluoro-uridine
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = OTHER; note = 2'-Fluoro-guanosine
  modified_base 4: mod_base = OTHER; note = 2'-O-methyl-adenosine
  modified_base 5: mod_base = OTHER; note = 2'-Fluoro-uridine
  modified_base 6: mod_base = um
  modified_base 7: mod_base = OTHER; note = 2'-Fluoro-uridine
  modified_base 8: mod_base = cm
  modified_base 9: mod_base = OTHER; note = 2'-Fluoro-cytidine
  modified_base 10: mod_base = um
  modified_base 11: mod_base = OTHER; note = 2'-Fluoro-adenosine
  modified_base 12: mod_base = OTHER; note = 2'-O-methyl-adenosine
  modified_base 13: mod_base = OTHER; note = 2'-Fluoro-uridine
  modified_base 14: mod_base = OTHER; note = 2'-O-methyl-adenosine
  modified_base 15: mod_base = OTHER; note = 2'-Fluoro-adenosine
  modified_base 16: mod_base = um
  modified_base 17: mod_base = OTHER; note = 2'-Fluoro-uridine
  modified_base 18: mod_base = OTHER; note = 2'-O-methyl-adenosine
  modified_base 19: mod_base = OTHER; note = 2'-Fluoro-uridine
tggatttcctaataattat

SEQ ID NO: 86 - RNA, 19 nt, synthetic construct
  source 1..19: mol_type = other RNA
  modified_base 1: mod_base = OTHER; note = 2'-Fluoro-uridine
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = OTHER; note = 2'-Fluoro-adenosine
  modified_base 4: mod_base = OTHER; note = 2'-O-methyl-adenosine
  modified_base 5: mod_base = OTHER; note = 2'-Fluoro-uridine
  modified_base 6: mod_base = um
  modified_base 7: mod_base = OTHER; note = 2'-Fluoro-uridine
  modified_base 8: mod_base = cm
  modified_base 9: mod_base = OTHER; note = 2'-Fluoro-cytidine
  modified_base 10: mod_base = um
  modified_base 11: mod_base = OTHER; note = 2'-Fluoro-adenosine
  modified_base 12: mod_base = um
  modified_base 13: mod_base = OTHER; note = 2'-Fluoro-guanosine
  modified_base 14: mod_base = um
  modified_base 15: mod_base = OTHER; note = 2'-Fluoro-adenosine
  modified_base 16: mod_base = um
  modified_base 17: mod_base = OTHER; note = 2'-Fluoro-uridine
  modified_base 18: mod_base = um
  modified_base 19: mod_base = OTHER; note = 2'-Fluoro-uridine
tgaatttcctatgtatttt

SEQ ID NO: 87 - RNA, 19 nt, synthetic construct
  source 1..19: mol_type = other RNA
  modified_base 1: mod_base = OTHER; note = 2'-Fluoro-guanosine
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = OTHER; note = 2'-Fluoro-uridine
  modified_base 4: mod_base = gm
  modified_base 5: mod_base = OTHER; note = 2'-Fluoro-guanosine
  modified_base 6: mod_base = OTHER; note = 2'-O-methyl-adenosine
  modified_base 7: mod_base = OTHER; note = 2'-Fluoro-uridine
  modified_base 8: mod_base = gm
  modified_base 9: mod_base = OTHER; note = 2'-Fluoro-uridine
  modified_base 10: mod_base = OTHER; note = 2'-O-methyl-adenosine
  modified_base 11: mod_base = OTHER; note = 2'-Fluoro-cytidine
  modified_base 12: mod_base = OTHER; note = 2'-O-methyl-adenosine
  modified_base 13: mod_base = OTHER; note = 2'-Fluoro-guanosine
  modified_base 14: mod_base = OTHER; note = 2'-O-methyl-adenosine
  modified_base 15: mod_base = OTHER; note = 2'-Fluoro-guanosine
  modified_base 16: mod_base = OTHER; note = 2'-O-methyl-adenosine
  modified_base 17: mod_base = OTHER; note = 2'-Fluoro-uridine
  modified_base 18: mod_base = OTHER; note = 2'-O-methyl-adenosine
  modified_base 19: mod_base = OTHER; note = 2'-Fluoro-cytidine
gctggatgtacagagatac

SEQ ID NO: 88 - RNA, 19 nt, synthetic construct
  source 1..19: mol_type = other RNA
  modified_base 1: mod_base = OTHER; note = 2'-Fluoro-cytidine
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = OTHER; note = 2'-Fluoro-adenosine
  modified_base 4: mod_base = OTHER; note = 2'-O-methyl-adenosine
  modified_base 5: mod_base = OTHER; note = 2'-Fluoro-adenosine
  modified_base 6: mod_base = gm
  modified_base 7: mod_base = OTHER; note = 2'-Fluoro-uridine
  modified_base 8: mod_base = gm
  modified_base 9: mod_base = OTHER; note = 2'-Fluoro-cytidine
  modified_base 10: mod_base = cm
  modified_base 11: mod_base = OTHER; note = 2'-Fluoro-uridine
  modified_base 12: mod_base = um
  modified_base 13: mod_base = OTHER; note = 2'-Fluoro-adenosine
  modified_base 14: mod_base = OTHER; note = 2'-O-methyl-adenosine
  modified_base 15: mod_base = OTHER; note = 2'-Fluoro-adenosine
  modified_base 16: mod_base = OTHER; note = 2'-O-methyl-adenosine
  modified_base 17: mod_base = OTHER; note = 2'-Fluoro-guanosine
  modified_base 18: mod_base = OTHER; note = 2'-O-methyl-adenosine
  modified_base 19: mod_base = OTHER; note = 2'-Fluoro-adenosine
ccaaagtgccttaaaagaa

SEQ ID NO: 89 - RNA, 19 nt, synthetic construct
  source 1..19: mol_type = other RNA
  modified_base 1: mod_base = OTHER; note = 2'-Fluoro-uridine
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = OTHER; note = 2'-Fluoro-uridine
  modified_base 4: mod_base = gm
  modified_base 5: mod_base = OTHER; note = 2'-Fluoro-uridine
  modified_base 6: mod_base = OTHER; note = 2'-O-methyl-adenosine
  modified_base 7: mod_base = OTHER; note = 2'-Fluoro-adenosine
  modified_base 8: mod_base = OTHER; note = 2'-O-methyl-adenosine
  modified_base 9: mod_base = OTHER; note = 2'-Fluoro-cytidine
  modified_base 10: mod_base = um
  modified_base 11: mod_base = OTHER; note = 2'-Fluoro-uridine
  modified_base 12: mod_base = gm
  modified_base 13: mod_base = OTHER; note = 2'-Fluoro-adenosine
  modified_base 14: mod_base = OTHER; note = 2'-O-methyl-adenosine
  modified_base 15: mod_base = OTHER; note = 2'-Fluoro-uridine
  modified_base 16: mod_base = um
  modified_base 17: mod_base = OTHER; note = 2'-Fluoro-uridine
  modified_base 18: mod_base = cm
  modified_base 19: mod_base = OTHER; note = 2'-Fluoro-cytidine
tatgtaaacttgaatttcc

SEQ ID NO: 90 - RNA, 19 nt, synthetic construct
  source 1..19: mol_type = other RNA
  modified_base 1: mod_base = OTHER; note = 2'-Fluoro-guanosine
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = OTHER; note = 2'-Fluoro-cytidine
  modified_base 4: mod_base = OTHER; note = 2'-O-methyl-adenosine
  modified_base 5: mod_base = OTHER; note = 2'-Fluoro-cytidine
  modified_base 6: mod_base = OTHER; note = 2'-O-methyl-adenosine
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = cm
  modified_base 11: mod_base = OTHER; note = 2'-Fluoro-cytidine
  modified_base 12: mod_base = gm
  modified_base 13: mod_base = OTHER; note = 2'-Fluoro-uridine
  modified_base 14: mod_base = um
  modified_base 15: mod_base = OTHER; note = 2'-Fluoro-guanosine
  modified_base 16: mod_base = cm
  modified_base 17: mod_base = OTHER; note = 2'-Fluoro-adenosine
  modified_base 18: mod_base = OTHER; note = 2'-O-methyl-adenosine
  modified_base 19: mod_base = OTHER; note = 2'-Fluoro-uridine
ggcacatttccgttgcaat

SEQ ID NO: 91 - RNA, 19 nt, synthetic construct
  source 1..19: mol_type = other RNA
  modified_base 1: mod_base = OTHER; note = 2'-Fluoro-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = OTHER; note = 2'-Fluoro-guanosine
  modified_base 4: mod_base = um
  modified_base 5: mod_base = OTHER; note = 2'-Fluoro-adenosine
  modified_base 6: mod_base = OTHER; note = 2'-O-methyl-adenosine
  modified_base 7: mod_base = OTHER; note = 2'-Fluoro-adenosine
  modified_base 8: mod_base = cm
  modified_base 9: mod_base = OTHER; note = 2'-Fluoro-uridine
  modified_base 10: mod_base = um
  modified_base 11: mod_base = OTHER; note = 2'-Fluoro-guanosine
  modified_base 12: mod_base = OTHER; note = 2'-O-methyl-adenosine
  modified_base 13: mod_base = OTHER; note = 2'-Fluoro-adenosine
  modified_base 14: mod_base = um
  modified_base 15: mod_base = OTHER; note = 2'-Fluoro-uridine
  modified_base 16: mod_base = um
  modified_base 17: mod_base = OTHER; note = 2'-Fluoro-cytidine
  modified_base 18: mod_base = cm
  modified_base 19: mod_base = OTHER; note = 2'-Fluoro-uridine
atgtaaacttgaatttcct

SEQ ID NO: 92 - RNA, 19 nt, synthetic construct
  source 1..19: mol_type = other RNA
  modified_base 1: mod_base = OTHER; note = 2'-Fluoro-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = OTHER; note = 2'-Fluoro-guanosine
  modified_base 4: mod_base = gm
  modified_base 5: mod_base = OTHER; note = 2'-Fluoro-adenosine
  modified_base 6: mod_base = um
  modified_base 7: mod_base = OTHER; note = 2'-Fluoro-uridine
  modified_base 8: mod_base = um
  modified_base 9: mod_base = OTHER; note = 2'-Fluoro-cytidine
  modified_base 10: mod_base = cm
  modified_base 11: mod_base = OTHER; note = 2'-Fluoro-uridine
  modified_base 12: mod_base = OTHER; note = 2'-O-methyl-adenosine
  modified_base 13: mod_base = OTHER; note = 2'-Fluoro-adenosine
  modified_base 14: mod_base = um
  modified_base 15: mod_base = OTHER; note = 2'-Fluoro-adenosine
  modified_base 16: mod_base = OTHER; note = 2'-O-methyl-adenosine
  modified_base 17: mod_base = OTHER; note = 2'-Fluoro-uridine
  modified_base 18: mod_base = um
  modified_base 19: mod_base = OTHER; note = 2'-Fluoro-adenosine
atggatttcctaataatta

SEQ ID NO: 93 - RNA, 19 nt, synthetic construct
  source 1..19: mol_type = other RNA
  modified_base 1: mod_base = OTHER; note = 2'-Fluoro-uridine
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = OTHER; note = 2'-Fluoro-uridine
  modified_base 4: mod_base = cm
  modified_base 5: mod_base = OTHER; note = 2'-Fluoro-uridine
  modified_base 6: mod_base = cm
  modified_base 7: mod_base = OTHER; note = 2'-Fluoro-uridine
  modified_base 8: mod_base = gm
  modified_base 9: mod_base = OTHER; note = 2'-Fluoro-cytidine
  modified_base 10: mod_base = um
  modified_base 11: mod_base = OTHER; note = 2'-Fluoro-cytidine
  modified_base 12: mod_base = um
  modified_base 13: mod_base = OTHER; note = 2'-Fluoro-adenosine
  modified_base 14: mod_base = OTHER; note = 2'-O-methyl-adenosine
  modified_base 15: mod_base = OTHER; note = 2'-Fluoro-guanosine
  modified_base 16: mod_base = um
  modified_base 17: mod_base = OTHER; note = 2'-Fluoro-adenosine
  modified_base 18: mod_base = OTHER; note = 2'-O-methyl-adenosine
  modified_base 19: mod_base = OTHER; note = 2'-Fluoro-adenosine
tgtctctgctctaagtaaa

SEQ ID NO: 94 - RNA, 19 nt, synthetic construct
  source 1..19: mol_type = other RNA
  modified_base 1: mod_base = OTHER; note = 2'-Fluoro-cytidine
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = OTHER; note = 2'-Fluoro-adenosine
  modified_base 4: mod_base = OTHER; note = 2'-O-methyl-adenosine
  modified_base 5: mod_base = OTHER; note = 2'-Fluoro-guanosine
  modified_base 6: mod_base = um
  modified_base 7: mod_base = OTHER; note = 2'-Fluoro-guanosine
  modified_base 8: mod_base = cm
  modified_base 9: mod_base = OTHER; note = 2'-Fluoro-cytidine
  modified_base 10: mod_base = um
  modified_base 11: mod_base = OTHER; note = 2'-Fluoro-uridine
  modified_base 12: mod_base = OTHER; note = 2'-O-methyl-adenosine
  modified_base 13: mod_base = OTHER; note = 2'-Fluoro-adenosine
  modified_base 14: mod_base = OTHER; note = 2'-O-methyl-adenosine
  modified_base 15: mod_base = OTHER; note = 2'-Fluoro-adenosine
  modified_base 16: mod_base = gm
  modified_base 17: mod_base = OTHER; note = 2'-Fluoro-adenosine
  modified_base 18: mod_base = OTHER; note = 2'-O-methyl-adenosine
  modified_base 19: mod_base = OTHER; note = 2'-Fluoro-adenosine
caaagtgccttaaaagaaa

SEQ ID NO: 95 - RNA, 19 nt, synthetic construct
  source 1..19: mol_type = other RNA
  modified_base 1: mod_base = OTHER; note = 2'-Fluoro-uridine
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = OTHER; note = 2'-Fluoro-adenosine
  modified_base 4: mod_base = OTHER; note = 2'-O-methyl-adenosine
  modified_base 5: mod_base = OTHER; note = 2'-Fluoro-uridine
  modified_base 6: mod_base = gm
  modified_base 7: mod_base = OTHER; note = 2'-Fluoro-uridine
  modified_base 8: mod_base = gm
  modified_base 9: mod_base = OTHER; note = 2'-Fluoro-cytidine
  modified_base 10: mod_base = cm
  modified_base 11: mod_base = OTHER; note = 2'-Fluoro-uridine
  modified_base 12: mod_base = um
  modified_base 13: mod_base = OTHER; note = 2'-Fluoro-uridine
  modified_base 14: mod_base = um
  modified_base 15: mod_base = OTHER; note = 2'-Fluoro-adenosine
  modified_base 16: mod_base = OTHER; note = 2'-O-methyl-adenosine
  modified_base 17: mod_base = OTHER; note = 2'-Fluoro-uridine
  modified_base 18: mod_base = um
  modified_base 19: mod_base = OTHER; note = 2'-Fluoro-adenosine
tgaatgtgccttttaatta

SEQ ID NO: 96 - RNA, 19 nt, synthetic construct
  source 1..19: mol_type = other RNA
  modified_base 1: mod_base = OTHER; note = 2'-Fluoro-adenosine
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = OTHER; note = 2'-Fluoro-uridine
  modified_base 4: mod_base = um
  modified_base 5: mod_base = OTHER; note = 2'-Fluoro-guanosine
  modified_base 6: mod_base = OTHER; note = 2'-O-methyl-adenosine
  modified_base 7: mod_base = OTHER; note = 2'-Fluoro-adenosine
  modified_base 8: mod_base = um
  modified_base 9: mod_base = OTHER; note = 2'-Fluoro-uridine
  modified_base 10: mod_base = um
  modified_base 11: mod_base = OTHER; note = 2'-Fluoro-cytidine
  modified_base 12: mod_base = cm
  modified_base 13: mod_base = OTHER; note = 2'-Fluoro-uridine
  modified_base 14: mod_base = OTHER; note = 2'-O-methyl-adenosine
  modified_base 15: mod_base = OTHER; note = 2'-Fluoro-uridine
  modified_base 16: mod_base = gm
  modified_base 17: mod_base = OTHER; note = 2'-Fluoro-uridine
  modified_base 18: mod_base = OTHER; note = 2'-O-methyl-adenosine
  modified_base 19: mod_base = OTHER; note = 2'-Fluoro-uridine
acttgaatttcctatgtat

SEQ ID NO: 97 - RNA, 19 nt, synthetic construct
  source 1..19: mol_type = other RNA
  modified_base 1: mod_base = OTHER; note = 2'-Fluoro-cytidine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = OTHER; note = 2'-Fluoro-guanosine
  modified_base 4: mod_base = OTHER; note = 2'-O-methyl-adenosine
  modified_base 5: mod_base = OTHER; note = 2'-Fluoro-cytidine
  modified_base 6: mod_base = um
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = cm
  modified_base 11: mod_base = OTHER; note = 2'-Fluoro-cytidine
  modified_base 12: mod_base = OTHER; note = 2'-O-methyl-adenosine
  modified_base 13: mod_base = OTHER; note = 2'-Fluoro-adenosine
  modified_base 14: mod_base = OTHER; note = 2'-O-methyl-adenosine
  modified_base 15: mod_base = OTHER; note = 2'-Fluoro-guanosine
  modified_base 16: mod_base = um
  modified_base 17: mod_base = OTHER; note = 2'-Fluoro-guanosine
  modified_base 18: mod_base = cm
  modified_base 19: mod_base = OTHER; note = 2'-Fluoro-cytidine
ctgacttttccaaagtgcc

SEQ ID NO: 98 - RNA, 19 nt, synthetic construct
  source 1..19: mol_type = other RNA
  modified_base 1: mod_base = OTHER; note = 2'-Fluoro-cytidine
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = OTHER; note = 2'-Fluoro-adenosine
  modified_base 4: mod_base = um
  modified_base 5: mod_base = OTHER; note = 2'-Fluoro-guanosine
  modified_base 6: mod_base = gm
  modified_base 7: mod_base = OTHER; note = 2'-Fluoro-adenosine
  modified_base 8: mod_base = um
  modified_base 9: mod_base = OTHER; note = 2'-Fluoro-uridine
  modified_base 10: mod_base = um
  modified_base 11: mod_base = OTHER; note = 2'-Fluoro-cytidine
  modified_base 12: mod_base = cm
  modified_base 13: mod_base = OTHER; note = 2'-Fluoro-uridine
  modified_base 14: mod_base = OTHER; note = 2'-O-methyl-adenosine
  modified_base 15: mod_base = OTHER; note = 2'-Fluoro-adenosine
  modified_base 16: mod_base = um
  modified_base 17: mod_base = OTHER; note = 2'-Fluoro-adenosine
  modified_base 18: mod_base = OTHER; note = 2'-O-methyl-adenosine
  modified_base 19: mod_base = OTHER; note = 2'-Fluoro-uridine
caatggatttcctaataat

SEQ ID NO: 99 - RNA, 19 nt, synthetic construct
  source 1..19: mol_type = other RNA
  modified_base 1: mod_base = OTHER; note = 2'-Fluoro-uridine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = OTHER; note = 2'-Fluoro-cytidine
  modified_base 4: mod_base = OTHER; note = 2'-O-methyl-adenosine
  modified_base 5: mod_base = OTHER; note = 2'-Fluoro-guanosine
  modified_base 6: mod_base = um
  modified_base 7: mod_base = OTHER; note = 2'-Fluoro-adenosine
  modified_base 8: mod_base = um
  modified_base 9: mod_base = OTHER; note = 2'-Fluoro-uridine
  modified_base 10: mod_base = um
  modified_base 11: mod_base = OTHER; note = 2'-Fluoro-uridine
  modified_base 12: mod_base = gm
  modified_base 13: mod_base = OTHER; note = 2'-Fluoro-guanosine
  modified_base 14: mod_base = OTHER; note = 2'-O-methyl-adenosine
  modified_base 15: mod_base = OTHER; note = 2'-Fluoro-guanosine
  modified_base 16: mod_base = gm
  modified_base 17: mod_base = OTHER; note = 2'-Fluoro-uridine
  modified_base 18: mod_base = gm
  modified_base 19: mod_base = OTHER; note = 2'-Fluoro-uridine
ttcagtattttggaggtgt

SEQ ID NO: 100 - RNA, 19 nt, synthetic construct
  source 1..19: mol_type = other RNA
  modified_base 1: mod_base = OTHER; note = 2'-Fluoro-cytidine
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = OTHER; note = 2'-Fluoro-uridine
  modified_base 4: mod_base = gm
  modified_base 5: mod_base = OTHER; note = 2'-Fluoro-adenosine
  modified_base 6: mod_base = cm
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = um
  modified_base 11: mod_base = OTHER; note = 2'-Fluoro-cytidine
  modified_base 12: mod_base = cm
  modified_base 13: mod_base = OTHER; note = 2'-Fluoro-adenosine
  modified_base 14: mod_base = OTHER; note = 2'-O-methyl-adenosine
  modified_base 15: mod_base = OTHER; note = 2'-Fluoro-adenosine
  modified_base 16: mod_base = gm
  modified_base 17: mod_base = OTHER; note = 2'-Fluoro-uridine
  modified_base 18: mod_base = gm
  modified_base 19: mod_base = OTHER; note = 2'-Fluoro-cytidine
cctgacttttccaaagtgc

SEQ ID NO: 101 - RNA, 19 nt, synthetic construct
  source 1..19: mol_type = other RNA
  modified_base 1: mod_base = OTHER; note = 2'-Fluoro-guanosine
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = OTHER; note = 2'-Fluoro-adenosine
  modified_base 4: mod_base = um
  modified_base 5: mod_base = OTHER; note = 2'-Fluoro-uridine
  modified_base 6: mod_base = um
  modified_base 7: mod_base = OTHER; note = 2'-Fluoro-cytidine
  modified_base 8: mod_base = cm
  modified_base 9: mod_base = OTHER; note = 2'-Fluoro-uridine
  modified_base 10: mod_base = OTHER; note = 2'-O-methyl-adenosine
  modified_base 11: mod_base = OTHER; note = 2'-Fluoro-adenosine
  modified_base 12: mod_base = um
  modified_base 13: mod_base = OTHER; note = 2'-Fluoro-adenosine
  modified_base 14: mod_base = OTHER; note = 2'-O-methyl-adenosine
  modified_base 15: mod_base = OTHER; note = 2'-Fluoro-uridine
  modified_base 16: mod_base = um
  modified_base 17: mod_base = OTHER; note = 2'-Fluoro-adenosine
  modified_base 18: mod_base = um
  modified_base 19: mod_base = OTHER; note = 2'-Fluoro-uridine
ggatttcctaataattatt

SEQ ID NO: 102 - RNA, 23 nt, Homo sapiens
  source 1..23: mol_type = mRNA
gtaaacttgaatttcctatgtat

SEQ ID NO: 103 - RNA, 23 nt, Homo sapiens
  source 1..23: mol_type = mRNA
gctatgtaaacttgaatttccta

SEQ ID NO: 104 - RNA, 23 nt, Homo sapiens
  source 1..23: mol_type = mRNA
tatgtaaacttgaatttcctatg

SEQ ID NO: 105 - RNA, 23 nt, Homo sapiens
  source 1..23: mol_type = mRNA
aacttgaatttcctatgtatttt

SEQ ID NO: 106 - RNA, 23 nt, Homo sapiens
  source 1..23: mol_type = mRNA
aaacttgaatttcctatgtattt

SEQ ID NO: 107 - RNA, 23 nt, Homo sapiens
  source 1..23: mol_type = mRNA
ctatgtaaacttgaatttcctat

SEQ ID NO: 108 - RNA, 23 nt, Homo sapiens
  source 1..23: mol_type = mRNA
gcatgctatgtaaacttgaattt

SEQ ID NO: 109 - RNA, 23 nt, Homo sapiens
  source 1..23: mol_type = mRNA
tgtctgatttctgaatgtaaagt

SEQ ID NO: 110 - RNA, 23 nt, Homo sapiens
  source 1..23: mol_type = mRNA
tgtaaacttgaatttcctatgta

SEQ ID NO: 111 - RNA, 23 nt, Homo sapiens
  source 1..23: mol_type = mRNA
tcaatggatttcctaataattat

SEQ ID NO: 112 - RNA, 23 nt, Homo sapiens
  source 1..23: mol_type = mRNA
caatggatttcctaataattatt

SEQ ID NO: 113 - RNA, 23 nt, Homo sapiens
  source 1..23: mol_type = mRNA
ggcatgctatgtaaacttgaatt

SEQ ID NO: 114 - RNA, 23 nt, Homo sapiens
  source 1..23: mol_type = mRNA
ttttggaggtgtctctgctctaa

SEQ ID NO: 115 - RNA, 23 nt, Homo sapiens
  source 1..23: mol_type = mRNA
aatcctcagaggtttgaccgaat

SEQ ID NO: 116 - RNA, 23 nt, Homo sapiens
  source 1..23: mol_type = mRNA
atcaatggatttcctaataatta

SEQ ID NO: 117 - RNA, 23 nt, Homo sapiens
  source 1..23: mol_type = mRNA
gacttttccaaagtgccttaaaa

SEQ ID NO: 118 - RNA, 23 nt, Homo sapiens
  source 1..23: mol_type = mRNA
catgctatgtaaacttgaatttc

SEQ ID NO: 119 - RNA, 23 nt, Homo sapiens
  source 1..23: mol_type = mRNA
ccatcaatggatttcctaataat

SEQ ID NO: 120 - RNA, 23 nt, Homo sapiens
  source 1..23: mol_type = mRNA
taaacttgaatttcctatgtatt

SEQ ID NO: 121 - RNA, 23 nt, Homo sapiens
  source 1..23: mol_type = mRNA
tctgctctaagtaaacaacagtt

SEQ ID NO: 122 - RNA, 23 nt, Homo sapiens
  source 1..23: mol_type = mRNA
atgctatgtaaacttgaatttcc

SEQ ID NO: 123 - RNA, 23 nt, Homo sapiens
  source 1..23: mol_type = mRNA
gaggtgtctctgctctaagtaaa

SEQ ID NO: 124 - RNA, 23 nt, Homo sapiens
  source 1..23: mol_type = mRNA
agcatgaatgtgccttttaatta

SEQ ID NO: 125 - RNA, 23 nt, Homo sapiens
  source 1..23: mol_type = mRNA
ggaggtgtctctgctctaagtaa

SEQ ID NO: 126 - RNA, 23 nt, Homo sapiens
  source 1..23: mol_type = mRNA
tttccaaagtgccttaaaagaaa

SEQ ID NO: 127 - RNA, 23 nt, Homo sapiens
  source 1..23: mol_type = mRNA
tgctatgtaaacttgaatttcct

SEQ ID NO: 128 - RNA, 23 nt, Homo sapiens
  source 1..23: mol_type = mRNA
ttcagtattttggaggtgtctct

SEQ ID NO: 129 - RNA, 23 nt, Homo sapiens
  source 1..23: mol_type = mRNA
ccagcatgaatgtgccttttaat

SEQ ID NO: 130 - RNA, 23 nt, Homo sapiens
  source 1..23: mol_type = mRNA
aggtgtctctgctctaagtaaac

SEQ ID NO: 131 - RNA, 23 nt, Homo sapiens
  source 1..23: mol_type = mRNA
ggaggagaagatgatgacatttt

SEQ ID NO: 132 - RNA, 23 nt, Homo sapiens
  source 1..23: mol_type = mRNA
ttggaggtgtctctgctctaagt

SEQ ID NO: 133 - RNA, 23 nt, Homo sapiens
  source 1..23: mol_type = mRNA
ttgtctgatttctgaatgtaaag

SEQ ID NO: 134 - RNA, 23 nt, Homo sapiens
  source 1..23: mol_type = mRNA
ccacggcacatttccgttgcaat

SEQ ID NO: 135 - RNA, 23 nt, Homo sapiens
  source 1..23: mol_type = mRNA
tggatttcctaataattattggg

SEQ ID NO: 136 - RNA, 23 nt, Homo sapiens
  source 1..23: mol_type = mRNA
tgttcagtattttggaggtgtct

SEQ ID NO: 137 - RNA, 23 nt, Homo sapiens
  source 1..23: mol_type = mRNA
catcaatggatttcctaataatt

SEQ ID NO: 138 - RNA, 23 nt, Homo sapiens
  source 1..23: mol_type = mRNA
caatcctcagaggtttgaccgaa

SEQ ID NO: 139 - RNA, 23 nt, Homo sapiens
  source 1..23: mol_type = mRNA
gatggtttgaactcactcaccta

SEQ ID NO: 140 - RNA, 23 nt, Homo sapiens
  source 1..23: mol_type = mRNA
ttttccaaagtgccttaaaagaa

SEQ ID NO: 141 - RNA, 23 nt, Homo sapiens
  source 1..23: mol_type = mRNA
acttttccaaagtgccttaaaag

SEQ ID NO: 142 - RNA, 23 nt, Homo sapiens
  source 1..23: mol_type = mRNA
ggtgtctctgctctaagtaaaca

SEQ ID NO: 143 - RNA, 23 nt, Homo sapiens
  source 1..23: mol_type = mRNA
atcctgacttttccaaagtgcct

SEQ ID NO: 144 - RNA, 23 nt, Homo sapiens
  source 1..23: mol_type = mRNA
gtattttggaggtgtctctgctc

SEQ ID NO: 145 - RNA, 23 nt, Homo sapiens
  source 1..23: mol_type = mRNA
atggtttgaactcactcacctac

SEQ ID NO: 146 - RNA, 23 nt, Homo sapiens
  source 1..23: mol_type = mRNA
attttggaggtgtctctgctcta

SEQ ID NO: 147 - RNA, 23 nt, Homo sapiens
  source 1..23: mol_type = mRNA
tgtctctgctctaagtaaacaac

SEQ ID NO: 148 - RNA, 23 nt, Homo sapiens
  source 1..23: mol_type = mRNA
cggcacatttccgttgcaatgga

SEQ ID NO: 149 - RNA, 23 nt, Homo sapiens
  source 1..23: mol_type = mRNA
gcatgaatgtgccttttaattag

SEQ ID NO: 150 - RNA, 23 nt, Homo sapiens
  source 1..23: mol_type = mRNA
cacggcacatttccgttgcaatg

SEQ ID NO: 151 - RNA, 23 nt, Homo sapiens
  source 1..23: mol_type = mRNA
tatacccaaatcacagtggacat

SEQ ID NO: 152 - RNA, 23 nt, Homo sapiens
  source 1..23: mol_type = mRNA
atcacagtggacatcgggacacc

SEQ ID NO: 153 - RNA, 23 nt, Homo sapiens
  source 1..23: mol_type = mRNA
gtgtctctgctctaagtaaacaa

SEQ ID NO: 154 - RNA, 23 nt, Homo sapiens
  source 1..23: mol_type = mRNA
cagatcctgacttttccaaagtg

SEQ ID NO: 155 - RNA, 23 nt, Homo sapiens
  source 1..23: mol_type = mRNA
cagcatgaatgtgccttttaatt

SEQ ID NO: 156 - RNA, 23 nt, Homo sapiens
  source 1..23: mol_type = mRNA
cttatgttcagtattttggaggt

SEQ ID NO: 157 - RNA, 23 nt, Homo sapiens
  source 1..23: mol_type = mRNA
aatggatttcctaataattattg

SEQ ID NO: 158 - RNA, 23 nt, Homo sapiens
  source 1..23: mol_type = mRNA
tggaggtgtctctgctctaagta

SEQ ID NO: 159 - RNA, 23 nt, Homo sapiens
  source 1..23: mol_type = mRNA
aggtgctggatgtacagagatac

SEQ ID NO: 160 - RNA, 23 nt, Homo sapiens
  source 1..23: mol_type = mRNA
ctgctctaagtaaacaacagttt

SEQ ID NO: 161 - RNA, 23 nt, Homo sapiens
  source 1..23: mol_type = mRNA
tctctgctctaagtaaacaacag

SEQ ID NO: 162 - RNA, 23 nt, Homo sapiens
  source 1..23: mol_type = mRNA
tatgttcagtattttggaggtgt

SEQ ID NO: 163 - RNA, 23 nt, Homo sapiens
  source 1..23: mol_type = mRNA
tattttggaggtgtctctgctct

SEQ ID NO: 164 - RNA, 23 nt, Homo sapiens
  source 1..23: mol_type = mRNA
acccaaatcacagtggacatcgg

SEQ ID NO: 165 - RNA, 23 nt, Homo sapiens
  source 1..23: mol_type = mRNA
ctctgctctaagtaaacaacagt

SEQ ID NO: 166 - RNA, 23 nt, Homo sapiens
  source 1..23: mol_type = mRNA
tttggaggtgtctctgctctaag

SEQ ID NO: 167 - RNA, 23 nt, Homo sapiens
  source 1..23: mol_type = mRNA
cttttccaaagtgccttaaaaga

SEQ ID NO: 168 - RNA, 23 nt, Homo sapiens
  source 1..23: mol_type = mRNA
ggtgctggatgtacagagatacc

SEQ ID NO: 169 - RNA, 23 nt, Homo sapiens
  source 1..23: mol_type = mRNA
gatcctgacttttccaaagtgcc

SEQ ID NO: 170 - RNA, 23 nt, Homo sapiens
  source 1..23: mol_type = mRNA
ctgcgtctctcctcacaaggtgg

SEQ ID NO: 171 - RNA, 23 nt, Homo sapiens
  source 1..23: mol_type = mRNA
atggatttcctaataattattgg

SEQ ID NO: 172 - RNA, 23 nt, Homo sapiens
  source 1..23: mol_type = mRNA
acggcacatttccgttgcaatgg

SEQ ID NO: 173 - RNA, 23 nt, Homo sapiens
  source 1..23: mol_type = mRNA
tgtatacccaaatcacagtggac

SEQ ID NO: 174 - RNA, 23 nt, Homo sapiens
  source 1..23: mol_type = mRNA
gttcagtattttggaggtgtctc

SEQ ID NO: 175 - RNA, 23 nt, Homo sapiens
  source 1..23: mol_type = mRNA
ggctttcaagaagccttgaagga

SEQ ID NO: 176 - RNA, 23 nt, Homo sapiens
  source 1..23: mol_type = mRNA
aattattggggctggggaggaga

SEQ ID NO: 177 - RNA, 23 nt, Homo sapiens
  source 1..23: mol_type = mRNA
ggacatcgggacaccgagctagc

SEQ ID NO: 178 - RNA, 23 nt, Homo sapiens
  source 1..23: mol_type = mRNA
agatcctgacttttccaaagtgc

SEQ ID NO: 179 - RNA, 23 nt, Homo sapiens
  source 1..23: mol_type = mRNA
gtatacccaaatcacagtggaca

SEQ ID NO: 180 - RNA, 23 nt, Homo sapiens
  source 1..23: mol_type = mRNA
ccattccgcaaccggcaggagca

SEQ ID NO: 181 - RNA, 23 nt, Homo sapiens
  source 1..23: mol_type = mRNA
gtgctggatgtacagagataccc

SEQ ID NO: 182 - RNA, 23 nt, Homo sapiens
  source 1..23: mol_type = mRNA
gactgcgtctctcctcacaaggt

SEQ ID NO: 183 - RNA, 23 nt, Homo sapiens
  source 1..23: mol_type = mRNA
caaatcacagtggacatcgggac

SEQ ID NO: 184 - RNA, 23 nt, Homo sapiens
  source 1..23: mol_type = mRNA
gtctctgctctaagtaaacaaca

SEQ ID NO: 185 - RNA, 23 nt, Homo sapiens
  source 1..23: mol_type = mRNA
atgttcagtattttggaggtgtc

SEQ ID NO: 186 - RNA, 23 nt, Homo sapiens
  source 1..23: mol_type = mRNA
attattggggctggggaggagaa

SEQ ID NO: 187 - RNA, 23 nt, Homo sapiens
  source 1..23: mol_type = mRNA
ccttatgttcagtattttggagg

SEQ ID NO: 188 - RNA, 23 nt, Homo sapiens
  source 1..23: mol_type = mRNA
atacccaaatcacagtggacatc

SEQ ID NO: 189 - RNA, 23 nt, Homo sapiens
  source 1..23: mol_type = mRNA
ggatttcctaataattattgggg

SEQ ID NO: 190 - RNA, 23 nt, Homo sapiens
  source 1..23: mol_type = mRNA
tcacagtggacatcgggacaccg

SEQ ID NO: 191 - RNA, 23 nt, Homo sapiens
  source 1..23: mol_type = mRNA
ttgtatacccaaatcacagtgga

SEQ ID NO: 192 - RNA, 23 nt, Homo sapiens
  source 1..23: mol_type = mRNA
attggggctggggaggagaagat

SEQ ID NO: 193 - RNA, 23 nt, Homo sapiens
  source 1..23: mol_type = mRNA
ttatgttcagtattttggaggtg

SEQ ID NO: 194 - RNA, 23 nt, Homo sapiens
  source 1..23: mol_type = mRNA
tggacatcgggacaccgagctag

SEQ ID NO: 195 - RNA, 23 nt, Homo sapiens
  source 1..23: mol_type = mRNA
acagtggacatcgggacaccgag

SEQ ID NO: 196 - RNA, 23 nt, Homo sapiens
  source 1..23: mol_type = mRNA
taattattggggctggggaggag

SEQ ID NO: 197 - RNA, 23 nt, Homo sapiens
  source 1..23: mol_type = mRNA
ttggggctggggaggagaagatg

SEQ ID NO: 198 - RNA, 23 nt, Homo sapiens
  source 1..23: mol_type = mRNA
ggactgcgtctctcctcacaagg

SEQ ID NO: 199 - RNA, 23 nt, Homo sapiens
  source 1..23: mol_type = mRNA
ctaataattattggggctgggga

SEQ ID NO: 200 - RNA, 23 nt, Homo sapiens
  source 1..23: mol_type = mRNA
aatcacagtggacatcgggacac

SEQ ID NO: 201 - RNA, 23 nt, Homo sapiens
  source 1..23: mol_type = mRNA
actgcgtctctcctcacaaggtg

SEQ ID NO: 202 - RNA, 23 nt, synthetic construct
  source 1..23: mol_type = other RNA
atacataggaaattcaagtttac

SEQ ID NO: 203 - RNA, 23 nt, synthetic construct
  source 1..23: mol_type = other RNA
taggaaattcaagtttacatagc

SEQ ID NO: 204 - RNA, 23 nt, synthetic construct
  source 1..23: mol_type = other RNA
cataggaaattcaagtttacata

SEQ ID NO: 205 - RNA, 23 nt, synthetic construct
  source 1..23: mol_type = other RNA
aaaatacataggaaattcaagtt

SEQ ID NO: 206 - RNA, 23 nt, synthetic construct
  source 1..23: mol_type = other RNA
aaatacataggaaattcaagttt

SEQ ID NO: 207 - RNA, 23 nt, synthetic construct
  source 1..23: mol_type = other RNA
ataggaaattcaagtttacatag

SEQ ID NO: 208 - RNA, 23 nt, synthetic construct
  source 1..23: mol_type = other RNA
aaattcaagtttacatagcatgc

SEQ ID NO: 209 - RNA, 23 nt, synthetic construct
  source 1..23: mol_type = other RNA
actttacattcagaaatcagaca

SEQ ID NO: 210 - RNA, 23 nt, synthetic construct
  source 1..23: mol_type = other RNA
tacataggaaattcaagtttaca

SEQ ID NO: 211 - RNA, 23 nt, synthetic construct
  source 1..23: mol_type = other RNA
ataattattaggaaatccattga

SEQ ID NO: 212 - RNA, 23 nt, synthetic construct
  source 1..23: mol_type = other RNA
aataattattaggaaatccattg

SEQ ID NO: 213 - RNA, 23 nt, synthetic construct
  source 1..23: mol_type = other RNA
aattcaagtttacatagcatgcc

SEQ ID NO: 214 - RNA, 23 nt, synthetic construct
  source 1..23: mol_type = other RNA
ttagagcagagacacctccaaaa

SEQ ID NO: 215 - RNA, 23 nt, synthetic construct
  source 1..23: mol_type = other RNA
attcggtcaaacctctgaggatt

SEQ ID NO: 216 - RNA, 23 nt, synthetic construct
  source 1..23: mol_type = other RNA
taattattaggaaatccattgat

SEQ ID NO: 217 - RNA, 23 nt, synthetic construct
  source 1..23: mol_type = other RNA
ttttaaggcactttggaaaagtc

SEQ ID NO: 218 - RNA, 23 nt, synthetic construct
  source 1..23: mol_type = other RNA
gaaattcaagtttacatagcatg

SEQ ID NO: 219 - RNA, 23 nt, synthetic construct
  source 1..23: mol_type = other RNA
attattaggaaatccattgatgg

SEQ ID NO: 220 - RNA, 23 nt, synthetic construct
  source 1..23: mol_type = other RNA
aatacataggaaattcaagttta

SEQ ID NO: 221 - RNA, 23 nt, synthetic construct
  source 1..23: mol_type = other RNA
aactgttgtttacttagagcaga

SEQ ID NO: 222 - RNA, 23 nt, synthetic construct
  source 1..23: mol_type = other RNA
ggaaattcaagtttacatagcat

SEQ ID NO: 223 - RNA, 23 nt, synthetic construct
  source 1..23: mol_type = other RNA
tttacttagagcagagacacctc

SEQ ID NO: 224 - RNA, 23 nt, synthetic construct
  source 1..23: mol_type = other RNA
taattaaaaggcacattcatgct

SEQ ID NO: 225 - RNA, 23 nt, synthetic construct
  source 1..23: mol_type = other RNA
ttacttagagcagagacacctcc

SEQ ID NO: 226 - RNA, 23 nt, synthetic construct
  source 1..23: mol_type = other RNA
tttcttttaaggcactttggaaa

SEQ ID NO: 227 - RNA, 23 nt, synthetic construct
  source 1..23: mol_type = other RNA
aggaaattcaagtttacatagca

SEQ ID NO: 228 - RNA, 23 nt, synthetic construct
  source 1..23: mol_type = other RNA
agagacacctccaaaatactgaa

SEQ ID NO: 229 - RNA, 23 nt, synthetic construct
  source 1..23: mol_type = other RNA
attaaaaggcacattcatgctgg

SEQ ID NO: 230 - RNA, 23 nt, synthetic construct
  source 1..23: mol_type = other RNA
gtttacttagagcagagacacct

SEQ ID NO: 231 - RNA, 23 nt, synthetic construct
  source 1..23: mol_type = other RNA
aaaatgtcatcatcttctcctcc

SEQ ID NO: 232 - RNA, 23 nt, synthetic construct
  source 1..23: mol_type = other RNA
acttagagcagagacacctccaa

SEQ ID NO: 233 - RNA, 23 nt, synthetic construct
  source 1..23: mol_type = other RNA
ctttacattcagaaatcagacaa

SEQ ID NO: 234 - RNA, 23 nt, synthetic construct
  source 1..23: mol_type = other RNA
attgcaacggaaatgtgccgtgg

SEQ ID NO: 235 - RNA, 23 nt, synthetic construct
  source 1..23: mol_type = other RNA
cccaataattattaggaaatcca

SEQ ID NO: 236 - RNA, 23 nt, synthetic construct
  source 1..23: mol_type = other RNA
agacacctccaaaatactgaaca

SEQ ID NO: 237 - RNA, 23 nt, synthetic construct
  source 1..23: mol_type = other RNA
aattattaggaaatccattgatg

SEQ ID NO: 238 - RNA, 23 nt, synthetic construct
  source 1..23: mol_type = other RNA
ttcggtcaaacctctgaggattg

SEQ ID NO: 239 - RNA, 23 nt, synthetic construct
  source 1..23: mol_type = other RNA
taggtgagtgagttcaaaccatc

SEQ ID NO: 240 - RNA, 23 nt, synthetic construct
  source 1..23: mol_type = other RNA
ttcttttaaggcactttggaaaa

SEQ ID NO: 241 - RNA, 23 nt, synthetic construct
  source 1..23: mol_type = other RNA
cttttaaggcactttggaaaagt

SEQ ID NO: 242 - RNA, 23 nt, synthetic construct
  source 1..23: mol_type = other RNA
tgtttacttagagcagagacacc

SEQ ID NO: 243 - RNA, 23 nt, synthetic construct
  source 1..23: mol_type = other RNA
aggcactttggaaaagtcaggat

SEQ ID NO: 244 - RNA, 23 nt, synthetic construct
  source 1..23: mol_type = other RNA
gagcagagacacctccaaaatac

SEQ ID NO: 245 - RNA, 23 nt, synthetic construct
  source 1..23: mol_type = other RNA
gtaggtgagtgagttcaaaccat

SEQ ID NO: 246 - RNA, 23 nt, synthetic construct
  source 1..23: mol_type = other RNA
tagagcagagacacctccaaaat

SEQ ID NO: 247 - RNA, 23 nt, synthetic construct
  source 1..23: mol_type = other RNA
gttgtttacttagagcagagaca

SEQ ID NO: 248 - RNA, 23 nt, synthetic construct
  source 1..23: mol_type = other RNA
tccattgcaacggaaatgtgccg

SEQ ID NO: 249 - RNA, 23 nt, synthetic construct
  source 1..23: mol_type = other RNA
ctaattaaaaggcacattcatgc

SEQ ID NO: 250 - RNA, 23 nt, synthetic construct
  source 1..23: mol_type = other RNA
cattgcaacggaaatgtgccgtg

SEQ ID NO: 251 - RNA, 23 nt, synthetic construct
  source 1..23: mol_type = other RNA
atgtccactgtgatttgggtata

SEQ ID NO: 252 - RNA, 23 nt, synthetic construct
  source 1..23: mol_type = other RNA
ggtgtcccgatgtccactgtgat

SEQ ID NO: 253 - RNA, 23 nt, synthetic construct
  source 1..23: mol_type = other RNA
ttgtttacttagagcagagacac

SEQ ID NO: 254 - RNA, 23 nt, synthetic construct
  source 1..23: mol_type = other RNA
cactttggaaaagtcaggatctg

SEQ ID NO: 255 - RNA, 23 nt, synthetic construct
  source 1..23: mol_type = other RNA
aattaaaaggcacattcatgctg

SEQ ID NO: 256 - RNA, 23 nt, synthetic construct
  source 1..23: mol_type = other RNA
acctccaaaatactgaacataag

SEQ ID NO: 257 - RNA, 23 nt, synthetic construct
  source 1..23: mol_type = other RNA
caataattattaggaaatccatt

SEQ ID NO: 258 - RNA, 23 nt, synthetic construct
  source 1..23: mol_type = other RNA
tacttagagcagagacacctcca

SEQ ID NO: 259 - RNA, 23 nt, synthetic construct
  source 1..23: mol_type = other RNA
gtatctctgtacatccagcacct

SEQ ID NO: 260 - RNA, 23 nt, synthetic construct
  source 1..23: mol_type = other RNA
aaactgttgtttacttagagcag

SEQ ID NO: 261 - RNA, 23 nt, synthetic construct
  source 1..23: mol_type = other RNA
ctgttgtttacttagagcagaga

SEQ ID NO: 262 - RNA, 23 nt, synthetic construct
  source 1..23: mol_type = other RNA
acacctccaaaatactgaacata

SEQ ID NO: 263 - RNA, 23 nt, synthetic construct
  source 1..23: mol_type = other RNA
agagcagagacacctccaaaata

SEQ ID NO: 264 - RNA, 23 nt, synthetic construct
  source 1..23: mol_type = other RNA
ccgatgtccactgtgatttgggt

SEQ ID NO: 265 - RNA, 23 nt, synthetic construct
  source 1..23: mol_type = other RNA
actgttgtttacttagagcagag

SEQ ID NO: 266 - RNA, 23 nt, synthetic construct
  source 1..23: mol_type = other RNA
cttagagcagagacacctccaaa

SEQ ID NO: 267 - RNA, 23 nt, synthetic construct
  source 1..23: mol_type = other RNA
tcttttaaggcactttggaaaag

SEQ ID NO: 268 - RNA, 23 nt, synthetic construct
  source 1..23: mol_type = other RNA
ggtatctctgtacatccagcacc

SEQ ID NO: 269 - RNA, 23 nt, synthetic construct
  source 1..23: mol_type = other RNA
ggcactttggaaaagtcaggatc

SEQ ID NO: 270 - RNA, 23 nt, synthetic construct
  source 1..23: mol_type = other RNA
ccaccttgtgaggagagacgcag

SEQ ID NO: 271 - RNA, 23 nt, synthetic construct
  source 1..23: mol_type = other RNA
ccaataattattaggaaatccat

SEQ ID NO: 272 - RNA, 23 nt, synthetic construct
  source 1..23: mol_type = other RNA
ccattgcaacggaaatgtgccgt

SEQ ID NO: 273 - RNA, 23 nt, synthetic construct
  source 1..23: mol_type = other RNA
gtccactgtgatttgggtataca

SEQ ID NO: 274 - RNA, 23 nt, synthetic construct
  source 1..23: mol_type = other RNA
gagacacctccaaaatactgaac

SEQ ID NO: 275 - RNA, 23 nt, synthetic construct
  source 1..23: mol_type = other RNA
tccttcaaggcttcttgaaagcc

SEQ ID NO: 276 - RNA, 23 nt, synthetic construct
  source 1..23: mol_type = other RNA
tctcctccccagccccaataatt

SEQ ID NO: 277 - RNA, 23 nt, synthetic construct
  source 1..23: mol_type = other RNA
gctagctcggtgtcccgatgtcc

SEQ ID NO: 278 - RNA, 23 nt, synthetic construct
  source 1..23: mol_type = other RNA
gcactttggaaaagtcaggatct

SEQ ID NO: 279 - RNA, 23 nt, synthetic construct
  source 1..23: mol_type = other RNA
tgtccactgtgatttgggtatac

SEQ ID NO: 280 - RNA, 23 nt, synthetic construct
  source 1..23: mol_type = other RNA
tgctcctgccggttgcggaatgg

SEQ ID NO: 281 - RNA, 23 nt, synthetic construct
  source 1..23: mol_type = other RNA
gggtatctctgtacatccagcac

SEQ ID NO: 282 - RNA, 23 nt, synthetic construct
  source 1..23: mol_type = other RNA
accttgtgaggagagacgcagtc

SEQ ID NO: 283 - RNA, 23 nt, synthetic construct
  source 1..23: mol_type = other RNA
gtcccgatgtccactgtgatttg

SEQ ID NO: 284 - RNA, 23 nt, synthetic construct
  source 1..23: mol_type = other RNA
tgttgtttacttagagcagagac

SEQ ID NO: 285 - RNA, 23 nt, synthetic construct
  source 1..23: mol_type = other RNA
gacacctccaaaatactgaacat

SEQ ID NO: 286 - RNA, 23 nt, synthetic construct
  source 1..23: mol_type = other RNA
ttctcctccccagccccaataat

SEQ ID NO: 287 - RNA, 23 nt, synthetic construct
  source 1..23: mol_type = other RNA
cctccaaaatactgaacataagg

SEQ ID NO: 288 - RNA, 23 nt, synthetic construct
  source 1..23: mol_type = other RNA
gatgtccactgtgatttgggtat

SEQ ID NO: 289 - RNA, 23 nt, synthetic construct
  source 1..23: mol_type = other RNA
ccccaataattattaggaaatcc

SEQ ID NO: 290 - RNA, 23 nt, synthetic construct
  source 1..23: mol_type = other RNA
cggtgtcccgatgtccactgtga

SEQ ID NO: 291 - RNA, 23 nt, synthetic construct
  source 1..23: mol_type = other RNA
tccactgtgatttgggtatacaa

SEQ ID NO: 292 - RNA, 23 nt, synthetic construct
  source 1..23: mol_type = other RNA
atcttctcctccccagccccaat

SEQ ID NO: 293 - RNA, 23 nt, synthetic construct
  source 1..23: mol_type = other RNA
cacctccaaaatactgaacataa

SEQ ID NO: 294 - RNA, 23 nt, synthetic construct
  source 1..23: mol_type = other RNA
ctagctcggtgtcccgatgtcca

SEQ ID NO: 295 - RNA, 23 nt, synthetic construct
  source 1..23: mol_type = other RNA
ctcggtgtcccgatgtccactgt

SEQ ID NO: 296 - RNA, 23 nt, synthetic construct
  source 1..23: mol_type = other RNA
ctcctccccagccccaataatta

SEQ ID NO: 297 - RNA, 23 nt, synthetic construct
  source 1..23: mol_type = other RNA
catcttctcctccccagccccaa

SEQ ID NO: 298 - RNA, 23 nt, synthetic construct
  source 1..23: mol_type = other RNA
ccttgtgaggagagacgcagtcc

SEQ ID NO: 299 - RNA, 23 nt, synthetic construct
  source 1..23: mol_type = other RNA
tccccagccccaataattattag

SEQ ID NO: 300 - RNA, 23 nt, synthetic construct
  source 1..23: mol_type = other RNA
gtgtcccgatgtccactgtgatt

SEQ ID NO: 301 - RNA, 23 nt, synthetic construct
  source 1..23: mol_type = other RNA
caccttgtgaggagagacgcagt

SEQ ID NO: 302 - RNA, 21 nt, synthetic construct
  source 1..21: mol_type = other RNA
aaacttgaatttcctatgtat

SEQ ID NO: 303 - RNA, 21 nt, synthetic construct
  source 1..21: mol_type = other RNA
tatgtaaacttgaatttccta

SEQ ID NO: 304 - RNA, 21 nt, synthetic construct
  source 1..21: mol_type = other RNA
tgtaaacttgaatttcctatg

SEQ ID NO: 305 - RNA, 21 nt, synthetic construct
  source 1..21: mol_type = other RNA
cttgaatttcctatgtatttt

SEQ ID NO: 306 - RNA, 21 nt, synthetic construct
  source 1..21: mol_type = other RNA
acttgaatttcctatgtattt

SEQ ID NO: 307 - RNA, 21 nt, synthetic construct
  source 1..21: mol_type = other RNA
atgtaaacttgaatttcctat

SEQ ID NO: 308 - RNA, 21 nt, synthetic construct
  source 1..21: mol_type = other RNA
atgctatgtaaacttgaattt

SEQ ID NO: 309 - RNA, 21 nt, synthetic construct
  source 1..21: mol_type = other RNA
tctgatttctgaatgtaaagt

SEQ ID NO: 310 - RNA, 21 nt, synthetic construct
  source 1..21: mol_type = other RNA
taaacttgaatttcctatgta

SEQ ID NO: 311 - RNA, 21 nt, synthetic construct
  source 1..21: mol_type = other RNA
aatggatttcctaataattat

SEQ ID NO: 312 - RNA, 21 nt, synthetic construct
  source 1..21: mol_type = other RNA
atggatttcctaataattatt

SEQ ID NO: 313 - RNA, 21 nt, synthetic construct
  source 1..21: mol_type = other RNA
catgctatgtaaacttgaatt

SEQ ID NO: 314 - RNA, 21 nt, synthetic construct
  source 1..21: mol_type = other RNA
ttggaggtgtctctgctctaa

SEQ ID NO: 315 - RNA, 21 nt, synthetic construct
  source 1..21: mol_type = other RNA
tcctcagaggtttgaccgaat

SEQ ID NO: 316 - RNA, 21 nt, synthetic construct
  source 1..21: mol_type = other RNA
caatggatttcctaataatta

SEQ ID NO: 317 - RNA, 21 nt, synthetic construct
  source 1..21: mol_type = other RNA
cttttccaaagtgccttaaaa

SEQ ID NO: 318 - RNA, 21 nt, synthetic construct
  source 1..21: mol_type = other RNA
tgctatgtaaacttgaatttc

SEQ ID NO: 319 - RNA, 21 nt, synthetic construct
  source 1..21: mol_type = other RNA
atcaatggatttcctaataat

SEQ ID NO: 320 - RNA, 21 nt, synthetic construct
  source 1..21: mol_type = other RNA
aacttgaatttcctatgtatt

SEQ ID NO: 321 - RNA, 21 nt, synthetic construct
  source 1..21: mol_type = other RNA
tgctctaagtaaacaacagtt

SEQ ID NO: 322 - RNA, 21 nt, synthetic construct
  source 1..21: mol_type = other RNA
gctatgtaaacttgaatttcc

SEQ ID NO: 323 - RNA, 21 nt, synthetic construct
  source 1..21: mol_type = other RNA
ggtgtctctgctctaagtaaa

SEQ ID NO: 324 - RNA, 21 nt, synthetic construct
  source 1..21: mol_type = other RNA
catgaatgtgccttttaatta

SEQ ID NO: 325 - RNA, 21 nt, synthetic construct
  source 1..21: mol_type = other RNA
aggtgtctctgctctaagtaa

SEQ ID NO: 326 - RNA, 21 nt, synthetic construct
  source 1..21: mol_type = other RNA
tccaaagtgccttaaaagaaa

SEQ ID NO: 327 - RNA, 21 nt, synthetic construct
  source 1..21: mol_type = other RNA
ctatgtaaacttgaatttcct

SEQ ID NO: 328 - RNA, 21 nt, synthetic construct
  source 1..21: mol_type = other RNA
cagtattttggaggtgtctct

SEQ ID NO: 329 - RNA, 21 nt, synthetic construct
  source 1..21: mol_type = other RNA
agcatgaatgtgccttttaat

SEQ ID NO: 330 - RNA, 21 nt, synthetic construct
  source 1..21: mol_type = other RNA
gtgtctctgctctaagtaaac

SEQ ID NO: 331 - RNA, 21 nt, synthetic construct
  source 1..21: mol_type = other RNA
aggagaagatgatgacatttt

SEQ ID NO: 332 - RNA, 21 nt, synthetic construct
  source 1..21: mol_type = other RNA
ggaggtgtctctgctctaagt

SEQ ID NO: 333 - RNA, 21 nt, synthetic construct
  source 1..21: mol_type = other RNA
gtctgatttctgaatgtaaag

SEQ ID NO: 334 - RNA, 21 nt, synthetic construct
  source 1..21: mol_type = other RNA
acggcacatttccgttgcaat

SEQ ID NO: 335 - RNA, 21 nt, synthetic construct
  source 1..21: mol_type = other RNA
gatttcctaataattattggg

SEQ ID NO: 336 - RNA, 21 nt, synthetic construct
  source 1..21: mol_type = other RNA
ttcagtattttggaggtgtct

SEQ ID NO: 337 - RNA, 21 nt, synthetic construct
  source 1..21: mol_type = other RNA
tcaatggatttcctaataatt

SEQ ID NO: 338 - RNA, 21 nt, synthetic construct
  source 1..21: mol_type = other RNA
atcctcagaggtttgaccgaa

SEQ ID NO: 339 - RNA, 21 nt, synthetic construct
  source 1..21: mol_type = other RNA
tggtttgaactcactcaccta

SEQ ID NO: 340 - RNA, 21 nt, synthetic construct
  source 1..21: mol_type = other RNA
ttccaaagtgccttaaaagaa

SEQ ID NO: 341 - RNA, 21 nt, synthetic construct
  source 1..21: mol_type = other RNA
ttttccaaagtgccttaaaag

SEQ ID NO: 342 - RNA, 21 nt, synthetic construct
  source 1..21: mol_type = other RNA
tgtctctgctctaagtaaaca

SEQ ID NO: 343 - RNA, 21 nt, synthetic construct
  source 1..21: mol_type = other RNA
cctgacttttccaaagtgcct

SEQ ID NO: 344 - RNA, 21 nt, synthetic construct
  source 1..21: mol_type = other RNA
attttggaggtgtctctgctc

SEQ ID NO: 345 - RNA, 21 nt, synthetic construct
  source 1..21: mol_type = other RNA
ggtttgaactcactcacctac

SEQ ID NO: 346 - RNA, 21 nt, synthetic construct
  source 1..21: mol_type = other RNA
tttggaggtgtctctgctcta

SEQ ID NO: 347 - RNA, 21 nt, synthetic construct
  source 1..21: mol_type = other RNA
tctctgctctaagtaaacaac

SEQ ID NO: 348 - RNA, 21 nt, synthetic construct
  source 1..21: mol_type = other RNA
gcacatttccgttgcaatgga

SEQ ID NO: 349 - RNA, 21 nt, synthetic construct
  source 1..21: mol_type = other RNA
atgaatgtgccttttaattag

SEQ ID NO: 350 - RNA, 21 nt, synthetic construct
  source 1..21: mol_type = other RNA
cggcacatttccgttgcaatg

SEQ ID NO: 351 - RNA, 21 nt, synthetic construct
  source 1..21: mol_type = other RNA
tacccaaatcacagtggacat

SEQ ID NO: 352 - RNA, 21 nt, synthetic construct
  source 1..21: mol_type = other RNA
cacagtggacatcgggacacc

SEQ ID NO: 353 - RNA, 21 nt, synthetic construct
  source 1..21: mol_type = other RNA
gtctctgctctaagtaaacaa

SEQ ID NO: 354 - RNA, 21 nt, synthetic construct
  source 1..21: mol_type = other RNA
gatcctgacttttccaaagtg

SEQ ID NO: 355 - RNA, 21 nt, synthetic construct
  source 1..21: mol_type = other RNA
gcatgaatgtgccttttaatt

SEQ ID NO: 356 - RNA, 21 nt, synthetic construct
  source 1..21: mol_type = other RNA
tatgttcagtattttggaggt

SEQ ID NO: 357 - RNA, 21 nt, synthetic construct
  source 1..21: mol_type = other RNA
tggatttcctaataattattg

SEQ ID NO: 358 - RNA, 21 nt, synthetic construct
  source 1..21: mol_type = other RNA
gaggtgtctctgctctaagta

SEQ ID NO: 359 - RNA, 21 nt, synthetic construct
  source 1..21: mol_type = other RNA
gtgctggatgtacagagatac

SEQ ID NO: 360 - RNA, 21 nt, synthetic construct
  source 1..21: mol_type = other RNA
gctctaagtaaacaacagttt

SEQ ID NO: 361 - RNA, 21 nt, synthetic construct
  source 1..21: mol_type = other RNA
tctgctctaagtaaacaacag

SEQ ID NO: 362 - RNA, 21 nt, synthetic construct
  source 1..21: mol_type = other RNA
tgttcagtattttggaggtgt

SEQ ID NO: 363 - RNA, 21 nt, synthetic construct
  source 1..21: mol_type = other RNA
ttttggaggtgtctctgctct

SEQ ID NO: 364 - RNA, 21 nt, synthetic construct
  source 1..21: mol_type = other RNA
ccaaatcacagtggacatcgg

SEQ ID NO: 365 - RNA, 21 nt, synthetic construct
  source 1..21: mol_type = other RNA
ctgctctaagtaaacaacagt

SEQ ID NO: 366 - RNA, 21 nt, synthetic construct
  source 1..21: mol_type = other RNA
tggaggtgtctctgctctaag

SEQ ID NO: 367 - RNA, 21 nt, synthetic construct
  source 1..21: mol_type = other RNA
tttccaaagtgccttaaaaga

SEQ ID NO: 368 - RNA, 21 nt, synthetic construct
  source 1..21: mol_type = other RNA
tgctggatgtacagagatacc

SEQ ID NO: 369 - RNA, 21 nt, synthetic construct
  source 1..21: mol_type = other RNA
tcctgacttttccaaagtgcc

SEQ ID NO: 370 - RNA, 21 nt, synthetic construct
  source 1..21: mol_type = other RNA
gcgtctctcctcacaaggtgg

SEQ ID NO: 371 - RNA, 21 nt, synthetic construct
  source 1..21: mol_type = other RNA
ggatttcctaataattattgg

SEQ ID NO: 372 - RNA, 21 nt, synthetic construct
  source 1..21: mol_type = other RNA
ggcacatttccgttgcaatgg

SEQ ID NO: 373 - RNA, 21 nt, synthetic construct
  source 1..21: mol_type = other RNA
tatacccaaatcacagtggac

SEQ ID NO: 374 - RNA, 21 nt, synthetic construct
  source 1..21: mol_type = other RNA
tcagtattttggaggtgtctc

SEQ ID NO: 375 - RNA, 21 nt, synthetic construct
  source 1..21: mol_type = other RNA
ctttcaagaagccttgaagga

SEQ ID NO: 376 - RNA, 21 nt, synthetic construct
  source 1..21: mol_type = other RNA
ttattggggctggggaggaga

SEQ ID NO: 377 - RNA, 21 nt, synthetic construct
  source 1..21: mol_type = other RNA
acatcgggacaccgagctagc

SEQ ID NO: 378 - RNA, 21 nt, synthetic construct
  source 1..21: mol_type = other RNA
atcctgacttttccaaagtgc

SEQ ID NO: 379 - RNA, 21 nt, synthetic construct
  source 1..21: mol_type = other RNA
atacccaaatcacagtggaca

SEQ ID NO: 380 - RNA, 21 nt, synthetic construct
  source 1..21: mol_type = other RNA
attccgcaaccggcaggagca

SEQ ID NO: 381 - RNA, 21 nt, synthetic construct
  source 1..21: mol_type = other RNA
gctggatgtacagagataccc

SEQ ID NO: 382 - RNA, 21 nt, synthetic construct
  source 1..21: mol_type = other RNA
ctgcgtctctcctcacaaggt

SEQ ID NO: 383 - RNA, 21 nt, synthetic construct
  source 1..21: mol_type = other RNA
aatcacagtggacatcgggac

SEQ ID NO: 384 - RNA, 21 nt, synthetic construct
  source 1..21: mol_type = other RNA
ctctgctctaagtaaacaaca

SEQ ID NO: 385 - RNA, 21 nt, synthetic construct
  source 1..21: mol_type = other RNA
gttcagtattttggaggtgtc

SEQ ID NO: 386 - RNA, 21 nt, synthetic construct
  source 1..21: mol_type = other RNA
tattggggctggggaggagaa

SEQ ID NO: 387 - RNA, 21 nt, synthetic construct
  source 1..21: mol_type = other RNA
ttatgttcagtattttggagg

SEQ ID NO: 388 - RNA, 21 nt, synthetic construct
  source 1..21: mol_type = other RNA
acccaaatcacagtggacatc

SEQ ID NO: 389 - RNA, 21 nt, synthetic construct
  source 1..21: mol_type = other RNA
atttcctaataattattgggg

SEQ ID NO: 390 - RNA, 21 nt, synthetic construct
  source 1..21: mol_type = other RNA
acagtggacatcgggacaccg

SEQ ID NO: 391 - RNA, 21 nt, synthetic construct
  source 1..21: mol_type = other RNA
gtatacccaaatcacagtgga

SEQ ID NO: 392 - RNA, 21 nt, synthetic construct
  source 1..21: mol_type = other RNA
tggggctggggaggagaagat

SEQ ID NO: 393 - RNA, 21 nt, synthetic construct
  source 1..21: mol_type = other RNA
atgttcagtattttggaggtg

SEQ ID NO: 394 - RNA, 21 nt, synthetic construct
  source 1..21: mol_type = other RNA
gacatcgggacaccgagctag

SEQ ID NO: 395 - RNA, 21 nt, synthetic construct
  source 1..21: mol_type = other RNA
agtggacatcgggacaccgag

SEQ ID NO: 396 - RNA, 21 nt, synthetic construct
  source 1..21: mol_type = other RNA
attattggggctggggaggag

SEQ ID NO: 397 - RNA, 21 nt, synthetic construct
  source 1..21: mol_type = other RNA
ggggctggggaggagaagatg

SEQ ID NO: 398 - RNA, 21 nt, synthetic construct
  source 1..21: mol_type = other RNA
actgcgtctctcctcacaagg

SEQ ID NO: 399 - RNA, 21 nt, synthetic construct
  source 1..21: mol_type = other RNA
aataattattggggctgggga

SEQ ID NO: 400 - RNA, 21 nt, synthetic construct
  source 1..21: mol_type = other RNA
tcacagtggacatcgggacac

SEQ ID NO: 401 - RNA, 21 nt, synthetic construct
  source 1..21: mol_type = other RNA
tgcgtctctcctcacaaggtg

SEQ ID NO: 402 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = um
  modified_base 4: mod_base = OTHER; note = 2'-O-methyl-adenosine
  modified_base 5: mod_base = cm
  modified_base 6: mod_base = OTHER; note = 2'-Fluoro-adenosine
  modified_base 7: mod_base = um
  modified_base 8: mod_base = OTHER; note = 2'-Fluoro-adenosine
  modified_base 9: mod_base = OTHER; note = 2'-Fluoro-guanosine
  modified_base 10: mod_base = gm
  modified_base 11: mod_base = OTHER; note = 2'-O-methyl-adenosine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-Fluoro-uridine
  modified_base 15: mod_base = um
  modified_base 16: mod_base = OTHER; note = 2'-Fluoro-cytidine
  modified_base 17: mod_base = OTHER; note = 2'-O-methyl-adenosine
  modified_base 18: mod_base = OTHER; note = 2'-O-methyl-adenosine
  modified_base 19: mod_base = gm
  modified_base 20: mod_base = um
  modified_base 21: mod_base = um
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = OTHER; note = 2'-O-methyl-adenosine
aatacataggaaattcaagttta

SEQ ID NO: 403 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = um
  modified_base 4: mod_base = um
  modified_base 5: mod_base = OTHER; note = 2'-O-methyl-adenosine
  modified_base 6: mod_base = OTHER; note = 2'-Fluoro-uridine
  modified_base 7: mod_base = um
  modified_base 8: mod_base = OTHER; note = 2'-Fluoro-adenosine
  modified_base 9: mod_base = OTHER; note = 2'-Fluoro-guanosine
  modified_base 10: mod_base = gm
  modified_base 11: mod_base = OTHER; note = 2'-O-methyl-adenosine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-Fluoro-uridine
  modified_base 15: mod_base = cm
  modified_base 16: mod_base = OTHER; note = 2'-Fluoro-cytidine
  modified_base 17: mod_base = OTHER; note = 2'-O-methyl-adenosine
  modified_base 18: mod_base = um
  modified_base 19: mod_base = um
  modified_base 20: mod_base = gm
  modified_base 21: mod_base = OTHER; note = 2'-O-methyl-adenosine
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = gm
aattattaggaaatccattgatg

SEQ ID NO: 404 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = cm
  modified_base 4: mod_base = OTHER; note = 2'-O-methyl-adenosine
  modified_base 5: mod_base = cm
  modified_base 6: mod_base = OTHER; note = 2'-Fluoro-cytidine
  modified_base 7: mod_base = um
  modified_base 8: mod_base = OTHER; note = 2'-Fluoro-cytidine
  modified_base 9: mod_base = OTHER; note = 2'-Fluoro-cytidine
  modified_base 10: mod_base = OTHER; note = 2'-O-methyl-adenosine
  modified_base 11: mod_base = OTHER; note = 2'-O-methyl-adenosine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-Fluoro-uridine
  modified_base 15: mod_base = OTHER; note = 2'-O-methyl-adenosine
  modified_base 16: mod_base = OTHER; note = 2'-Fluoro-cytidine
  modified_base 17: mod_base = um
  modified_base 18: mod_base = gm
  modified_base 19: mod_base = OTHER; note = 2'-O-methyl-adenosine
  modified_base 20: mod_base = OTHER; note = 2'-O-methyl-adenosine
  modified_base 21: mod_base = cm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = um
gacacctccaaaatactgaacat

SEQ ID NO: 405 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-O-methyl-adenosine
  modified_base 5: mod_base = um
  modified_base 6: mod_base = OTHER; note = 2'-Fluoro-uridine
  modified_base 7: mod_base = OTHER; note = 2'-O-methyl-adenosine
  modified_base 8: mod_base = OTHER; note = 2'-Fluoro-uridine
  modified_base 9: mod_base = OTHER; note = 2'-Fluoro-uridine
  modified_base 10: mod_base = OTHER; note = 2'-O-methyl-adenosine
  modified_base 11: mod_base = gm
  modified_base 12: mod_base = gm
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-uridine
  modified_base 17: mod_base = cm
  modified_base 18: mod_base = cm
  modified_base 19: mod_base = OTHER; note = 2'-O-methyl-adenosine
  modified_base 20: mod_base = um
  modified_base 21: mod_base = um
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = OTHER; note = 2'-O-methyl-adenosine
ataattattaggaaatccattga

SEQ ID NO: 406 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-O-methyl-adenosine
  modified_base 5: mod_base = um
  modified_base 6: mod_base = OTHER; note = 2'-Fluoro-adenosine
  modified_base 7: mod_base = cm
  modified_base 8: mod_base = OTHER; note = 2'-Fluoro-adenosine
  modified_base 9: mod_base = OTHER; note = 2'-Fluoro-uridine
  modified_base 10: mod_base = OTHER; note = 2'-O-methyl-adenosine
  modified_base 11: mod_base = gm
  modified_base 12: mod_base = gm
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-uridine
  modified_base 17: mod_base = um
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = um
aaaatacataggaaattcaagtt

SEQ ID NO: 407 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = cm
  modified_base 6: mod_base = OTHER; note = 2'-Fluoro-uridine
  modified_base 7: mod_base = cm
  modified_base 8: mod_base = OTHER; note = 2'-Fluoro-uridine
  modified_base 9: mod_base = OTHER; note = 2'-Fluoro-guanosine
  modified_base 10: mod_base = um
  modified_base 11: mod_base = OTHER; note = 2'-O-methyl-adenosine
  modified_base 12: mod_base = cm
  modified_base 13: mod_base = OTHER; note = 2'-O-methyl-adenosine
  modified_base 14: mod_base = OTHER; note = 2'-Fluoro-uridine
  modified_base 15: mod_base = cm
  modified_base 16: mod_base = OTHER; note = 2'-Fluoro-cytidine
  modified_base 17: mod_base = OTHER; note = 2'-O-methyl-adenosine
  modified_base 18: mod_base = gm
  modified_base 19: mod_base = cm
  modified_base 20: mod_base = OTHER; note = 2'-O-methyl-adenosine
  modified_base 21: mod_base = cm
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = um
gtatctctgtacatccagcacct

SEQ ID NO: 408 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = cm
  modified_base 4: mod_base = um
  modified_base 5: mod_base = um
  modified_base 6: mod_base = OTHER; note = 2'-Fluoro-uridine
  modified_base 7: mod_base = um
  modified_base 8: mod_base = OTHER; note = 2'-Fluoro-adenosine
  modified_base 9: mod_base = OTHER; note = 2'-Fluoro-adenosine
  modified_base 10: mod_base = gm
  modified_base 11: mod_base = gm
  modified_base 12: mod_base = cm
  modified_base 13: mod_base = OTHER; note = 2'-O-methyl-adenosine
  modified_base 14: mod_base = OTHER; note = 2'-Fluoro-cytidine
  modified_base 15: mod_base = um
  modified_base 16: mod_base = OTHER; note = 2'-Fluoro-uridine
  modified_base 17: mod_base = um
  modified_base 18: mod_base = gm
  modified_base 19: mod_base = gm
  modified_base 20: mod_base = OTHER; note = 2'-O-methyl-adenosine
  modified_base 21: mod_base = OTHER; note = 2'-O-methyl-adenosine
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = OTHER; note = 2'-O-methyl-adenosine
ttcttttaaggcactttggaaaa

SEQ ID NO: 409 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-O-methyl-adenosine
  modified_base 5: mod_base = OTHER; note = 2'-O-methyl-adenosine
  modified_base 6: mod_base = OTHER; note = 2'-Fluoro-uridine
  modified_base 7: mod_base = um
  modified_base 8: mod_base = OTHER; note = 2'-Fluoro-cytidine
  modified_base 9: mod_base = OTHER; note = 2'-Fluoro-adenosine
  modified_base 10: mod_base = OTHER; note = 2'-O-methyl-adenosine
  modified_base 11: mod_base = gm
  modified_base 12: mod_base = um
  modified_base 13: mod_base = um
  modified_base 14: mod_base = OTHER; note = 2'-Fluoro-uridine
  modified_base 15: mod_base = OTHER; note = 2'-O-methyl-adenosine
  modified_base 16: mod_base = OTHER; note = 2'-Fluoro-cytidine
  modified_base 17: mod_base = OTHER; note = 2'-O-methyl-adenosine
  modified_base 18: mod_base = um
  modified_base 19: mod_base = OTHER; note = 2'-O-methyl-adenosine
  modified_base 20: mod_base = gm
  modified_base 21: mod_base = cm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = um
ggaaattcaagtttacatagcat

SEQ ID NO: 410 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = gm
  modified_base 5: mod_base = cm
  modified_base 6: mod_base = OTHER; note = 2'-Fluoro-adenosine
  modified_base 7: mod_base = OTHER; note = 2'-O-methyl-adenosine
  modified_base 8: mod_base = OTHER; note = 2'-Fluoro-cytidine
  modified_base 9: mod_base = OTHER; note = 2'-Fluoro-guanosine
  modified_base 10: mod_base = gm
  modified_base 11: mod_base = OTHER; note = 2'-O-methyl-adenosine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-Fluoro-uridine
  modified_base 15: mod_base = gm
  modified_base 16: mod_base = OTHER; note = 2'-Fluoro-uridine
  modified_base 17: mod_base = gm
  modified_base 18: mod_base = cm
  modified_base 19: mod_base = cm
  modified_base 20: mod_base = gm
  modified_base 21: mod_base = um
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = gm
attgcaacggaaatgtgccgtgg

SEQ ID NO: 411 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = gm
  modified_base 4: mod_base = OTHER; note = 2'-O-methyl-adenosine
  modified_base 5: mod_base = OTHER; note = 2'-O-methyl-adenosine
  modified_base 6: mod_base = OTHER; note = 2'-Fluoro-adenosine
  modified_base 7: mod_base = um
  modified_base 8: mod_base = OTHER; note = 2'-Fluoro-uridine
  modified_base 9: mod_base = OTHER; note = 2'-Fluoro-cytidine
  modified_base 10: mod_base = OTHER; note = 2'-O-methyl-adenosine
  modified_base 11: mod_base = OTHER; note = 2'-O-methyl-adenosine
  modified_base 12: mod_base = gm
  modified_base 13: mod_base = um
  modified_base 14: mod_base = OTHER; note = 2'-Fluoro-uridine
  modified_base 15: mod_base = um
  modified_base 16: mod_base = OTHER; note = 2'-Fluoro-adenosine
  modified_base 17: mod_base = cm
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = gm
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = OTHER; note = 2'-O-methyl-adenosine
aggaaattcaagtttacatagca

SEQ ID NO: 412 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = um
  modified_base 6: mod_base = OTHER; note = 2'-Fluoro-adenosine
  modified_base 7: mod_base = um
  modified_base 8: mod_base = OTHER; note = 2'-Fluoro-uridine
  modified_base 9: mod_base = OTHER; note = 2'-Fluoro-adenosine
  modified_base 10: mod_base = gm
  modified_base 11: mod_base = gm
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-Fluoro-adenosine
  modified_base 15: mod_base = um
  modified_base 16: mod_base = OTHER; note = 2'-Fluoro-cytidine
  modified_base 17: mod_base = cm
  modified_base 18: mod_base = OTHER; note = 2'-O-methyl-adenosine
  modified_base 19: mod_base = um
  modified_base 20: mod_base = um
  modified_base 21: mod_base = gm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = um
taattattaggaaatccattgat

SEQ ID NO: 413 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = OTHER; note = 2'-O-methyl-adenosine
  modified_base 5: mod_base = cm
  modified_base 6: mod_base = OTHER; note = 2'-Fluoro-uridine
  modified_base 7: mod_base = um
  modified_base 8: mod_base = OTHER; note = 2'-Fluoro-adenosine
  modified_base 9: mod_base = OTHER; note = 2'-Fluoro-guanosine
  modified_base 10: mod_base = OTHER; note = 2'-O-methyl-adenosine
  modified_base 11: mod_base = gm
  modified_base 12: mod_base = cm
  modified_base 13: mod_base = OTHER; note = 2'-O-methyl-adenosine
  modified_base 14: mod_base = OTHER; note = 2'-Fluoro-guanosine
  modified_base 15: mod_base = OTHER; note = 2'-O-methyl-adenosine
  modified_base 16: mod_base = OTHER; note = 2'-Fluoro-guanosine
  modified_base 17: mod_base = OTHER; note = 2'-O-methyl-adenosine
  modified_base 18: mod_base = cm
  modified_base 19: mod_base = OTHER; note = 2'-O-methyl-adenosine
  modified_base 20: mod_base = cm
  modified_base 21: mod_base = cm
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = cm
tttacttagagcagagacacctc

SEQ ID NO: 414 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = cm
  modified_base 5: mod_base = um
  modified_base 6: mod_base = OTHER; note = 2'-Fluoro-uridine
  modified_base 7: mod_base = um
  modified_base 8: mod_base = OTHER; note = 2'-Fluoro-uridine
  modified_base 9: mod_base = OTHER; note = 2'-Fluoro-adenosine
  modified_base 10: mod_base = OTHER; note = 2'-O-methyl-adenosine
  modified_base 11: mod_base = gm
  modified_base 12: mod_base = gm
  modified_base 13: mod_base = cm
  modified_base 14: mod_base = OTHER; note = 2'-Fluoro-adenosine
  modified_base 15: mod_base = cm
  modified_base 16: mod_base = OTHER; note = 2'-Fluoro-uridine
  modified_base 17: mod_base = um
  modified_base 18: mod_base = um
  modified_base 19: mod_base = gm
  modified_base 20: mod_base = gm
  modified_base 21: mod_base = OTHER; note = 2'-O-methyl-adenosine
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = OTHER; note = 2'-O-methyl-adenosine
tttcttttaaggcactttggaaa

SEQ ID NO: 415 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = um
  modified_base 6: mod_base = OTHER; note = 2'-Fluoro-adenosine
  modified_base 7: mod_base = OTHER; note = 2'-O-methyl-adenosine
  modified_base 8: mod_base = OTHER; note = 2'-Fluoro-adenosine
  modified_base 9: mod_base = OTHER; note = 2'-Fluoro-adenosine
  modified_base 10: mod_base = gm
  modified_base 11: mod_base = gm
  modified_base 12: mod_base = cm
  modified_base 13: mod_base = OTHER; note = 2'-O-methyl-adenosine
  modified_base 14: mod_base = OTHER; note = 2'-Fluoro-cytidine
  modified_base 15: mod_base = OTHER; note = 2'-O-methyl-adenosine
  modified_base 16: mod_base = OTHER; note = 2'-Fluoro-uridine
  modified_base 17: mod_base = um
  modified_base 18: mod_base = cm
  modified_base 19: mod_base = OTHER; note = 2'-O-methyl-adenosine
  modified_base 20: mod_base = um
  modified_base 21: mod_base = gm
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = um
taattaaaaggcacattcatgct

SEQ ID NO: 416 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = OTHER; note = 2'-O-methyl-adenosine
  modified_base 6: mod_base = OTHER; note = 2'-Fluoro-uridine
  modified_base 7: mod_base = OTHER; note = 2'-O-methyl-adenosine
  modified_base 8: mod_base = OTHER; note = 2'-Fluoro-guanosine
  modified_base 9: mod_base = OTHER; note = 2'-Fluoro-guanosine
  modified_base 10: mod_base = OTHER; note = 2'-O-methyl-adenosine
  modified_base 11: mod_base = OTHER; note = 2'-O-methyl-adenosine
  modified_base 12: mod_base = OTHER; note = 2'-O-methyl-adenosine
  modified_base 13: mod_base = um
  modified_base 14: mod_base = OTHER; note = 2'-Fluoro-uridine
  modified_base 15: mod_base = cm
  modified_base 16: mod_base = OTHER; note = 2'-Fluoro-adenosine
  modified_base 17: mod_base = OTHER; note = 2'-O-methyl-adenosine
  modified_base 18: mod_base = gm
  modified_base 19: mod_base = um
  modified_base 20: mod_base = um
  modified_base 21: mod_base = um
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = cm
atacataggaaattcaagtttac

SEQ ID NO: 417 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = cm
  modified_base 4: mod_base = OTHER; note = 2'-O-methyl-adenosine
  modified_base 5: mod_base = cm
  modified_base 6: mod_base = OTHER; note = 2'-Fluoro-uridine
  modified_base 7: mod_base = um
  modified_base 8: mod_base = OTHER; note = 2'-Fluoro-uridine
  modified_base 9: mod_base = OTHER; note = 2'-Fluoro-guanosine
  modified_base 10: mod_base = gm
  modified_base 11: mod_base = OTHER; note = 2'-O-methyl-adenosine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-Fluoro-adenosine
  modified_base 15: mod_base = gm
  modified_base 16: mod_base = OTHER; note = 2'-Fluoro-uridine
  modified_base 17: mod_base = cm
  modified_base 18: mod_base = OTHER; note = 2'-O-methyl-adenosine
  modified_base 19: mod_base = gm
  modified_base 20: mod_base = gm
  modified_base 21: mod_base = OTHER; note = 2'-O-methyl-adenosine
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = cm
ggcactttggaaaagtcaggatc

SEQ ID NO: 418 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = OTHER; note = 2'-O-methyl-adenosine
  modified_base 5: mod_base = um
  modified_base 6: mod_base = OTHER; note = 2'-Fluoro-uridine
  modified_base 7: mod_base = OTHER; note = 2'-O-methyl-adenosine
  modified_base 8: mod_base = OTHER; note = 2'-Fluoro-guanosine
  modified_base 9: mod_base = OTHER; note = 2'-Fluoro-guanosine
  modified_base 10: mod_base = OTHER; note = 2'-O-methyl-adenosine
  modified_base 11: mod_base = OTHER; note = 2'-O-methyl-adenosine
  modified_base 12: mod_base = OTHER; note = 2'-O-methyl-adenosine
  modified_base 13: mod_base = um
  modified_base 14: mod_base = OTHER; note = 2'-Fluoro-cytidine
  modified_base 15: mod_base = cm
  modified_base 16: mod_base = OTHER; note = 2'-Fluoro-adenosine
  modified_base 17: mod_base = um
  modified_base 18: mod_base = um
  modified_base 19: mod_base = gm
  modified_base 20: mod_base = OTHER; note = 2'-O-methyl-adenosine
  modified_base 21: mod_base = um
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = gm
attattaggaaatccattgatgg

SEQ ID NO: 419 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = cm
  modified_base 6: mod_base = OTHER; note = 2'-Fluoro-uridine
  modified_base 7: mod_base = cm
  modified_base 8: mod_base = OTHER; note = 2'-Fluoro-cytidine
  modified_base 9: mod_base = OTHER; note = 2'-Fluoro-adenosine
  modified_base 10: mod_base = OTHER; note = 2'-O-methyl-adenosine
  modified_base 11: mod_base = OTHER; note = 2'-O-methyl-adenosine
  modified_base 12: mod_base = OTHER; note = 2'-O-methyl-adenosine
  modified_base 13: mod_base = um
  modified_base 14: mod_base = OTHER; note = 2'-Fluoro-adenosine
  modified_base 15: mod_base = cm
  modified_base 16: mod_base = OTHER; note = 2'-Fluoro-uridine
  modified_base 17: mod_base = gm
  modified_base 18: mod_base = OTHER; note = 2'-O-methyl-adenosine
  modified_base 19: mod_base = OTHER; note = 2'-O-methyl-adenosine
  modified_base 20: mod_base = cm
  modified_base 21: mod_base = OTHER; note = 2'-O-methyl-adenosine
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = OTHER; note = 2'-O-methyl-adenosine
acacctccaaaatactgaacata

SEQ ID NO: 420 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = um
  modified_base 6: mod_base = OTHER; note = 2'-Fluoro-uridine
  modified_base 7: mod_base = um
  modified_base 8: mod_base = OTHER; note = 2'-Fluoro-guanosine
  modified_base 9: mod_base = OTHER; note = 2'-Fluoro-guanosine
  modified_base 10: mod_base = OTHER; note = 2'-O-methyl-adenosine
  modified_base 11: mod_base = OTHER; note = 2'-O-methyl-adenosine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-Fluoro-guanosine
  modified_base 15: mod_base = um
  modified_base 16: mod_base = OTHER; note = 2'-Fluoro-cytidine
  modified_base 17: mod_base = OTHER; note = 2'-O-methyl-adenosine
  modified_base 18: mod_base = gm
  modified_base 19: mod_base = gm
  modified_base 20: mod_base = OTHER; note = 2'-O-methyl-adenosine
  modified_base 21: mod_base = um
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = um
gcactttggaaaagtcaggatct

SEQ ID NO: 421 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = um
  modified_base 4: mod_base = OTHER; note = 2'-O-methyl-adenosine
  modified_base 5: mod_base = OTHER; note = 2'-O-methyl-adenosine
  modified_base 6: mod_base = OTHER; note = 2'-Fluoro-uridine
  modified_base 7: mod_base = um
  modified_base 8: mod_base = OTHER; note = 2'-Fluoro-adenosine
  modified_base 9: mod_base = OTHER; note = 2'-Fluoro-uridine
  modified_base 10: mod_base = um
  modified_base 11: mod_base = OTHER; note = 2'-O-methyl-adenosine
  modified_base 12: mod_base = gm
  modified_base 13: mod_base = gm
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-adenosine
  modified_base 17: mod_base = um
  modified_base 18: mod_base = cm
  modified_base 19: mod_base = cm
  modified_base 20: mod_base = OTHER; note = 2'-O-methyl-adenosine
  modified_base 21: mod_base = um
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = gm
aataattattaggaaatccattg

SEQ ID NO: 422 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = OTHER; note = 2'-O-methyl-adenosine
  modified_base 5: mod_base = OTHER; note = 2'-O-methyl-adenosine
  modified_base 6: mod_base = OTHER; note = 2'-Fluoro-adenosine
  modified_base 7: mod_base = OTHER; note = 2'-O-methyl-adenosine
  modified_base 8: mod_base = OTHER; note = 2'-Fluoro-guanosine
  modified_base 9: mod_base = OTHER; note = 2'-Fluoro-guanosine
  modified_base 10: mod_base = cm
  modified_base 11: mod_base = OTHER; note = 2'-O-methyl-adenosine
  modified_base 12: mod_base = cm
  modified_base 13: mod_base = OTHER; note = 2'-O-methyl-adenosine
  modified_base 14: mod_base = OTHER; note = 2'-Fluoro-uridine
  modified_base 15: mod_base = um
  modified_base 16: mod_base = OTHER; note = 2'-Fluoro-cytidine
  modified_base 17: mod_base = OTHER; note = 2'-O-methyl-adenosine
  modified_base 18: mod_base = um
  modified_base 19: mod_base = gm
  modified_base 20: mod_base = cm
  modified_base 21: mod_base = um
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = gm
attaaaaggcacattcatgctgg

SEQ ID NO: 423 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = um
  modified_base 4: mod_base = um
  modified_base 5: mod_base = um
  modified_base 6: mod_base = OTHER; note = 2'-Fluoro-adenosine
  modified_base 7: mod_base = cm
  modified_base 8: mod_base = OTHER; note = 2'-Fluoro-uridine
  modified_base 9: mod_base = OTHER; note = 2'-Fluoro-uridine
  modified_base 10: mod_base = OTHER; note = 2'-O-methyl-adenosine
  modified_base 11: mod_base = gm
  modified_base 12: mod_base = OTHER; note = 2'-O-methyl-adenosine
  modified_base 13: mod_base = gm
  modified_base 14: mod_base = OTHER; note = 2'-Fluoro-cytidine
  modified_base 15: mod_base = OTHER; note = 2'-O-methyl-adenosine
  modified_base 16: mod_base = OTHER; note = 2'-Fluoro-guanosine
  modified_base 17: mod_base = OTHER; note = 2'-O-methyl-adenosine
  modified_base 18: mod_base = gm
  modified_base 19: mod_base = OTHER; note = 2'-O-methyl-adenosine
  modified_base 20: mod_base = cm
  modified_base 21: mod_base = OTHER; note = 2'-O-methyl-adenosine
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = cm
tgtttacttagagcagagacacc

SEQ ID NO: 424 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = cm
  modified_base 4: mod_base = cm
  modified_base 5: mod_base = um
  modified_base 6: mod_base = OTHER; note = 2'-Fluoro-cytidine
  modified_base 7: mod_base = cm
  modified_base 8: mod_base = OTHER; note = 2'-Fluoro-adenosine
  modified_base 9: mod_base = OTHER; note = 2'-Fluoro-adenosine
  modified_base 10: mod_base = OTHER; note = 2'-O-methyl-adenosine
  modified_base 11: mod_base = OTHER; note = 2'-O-methyl-adenosine
  modified_base 12: mod_base = um
  modified_base 13: mod_base = OTHER; note = 2'-O-methyl-adenosine
  modified_base 14: mod_base = OTHER; note = 2'-Fluoro-cytidine
  modified_base 15: mod_base = um
  modified_base 16: mod_base = OTHER; note = 2'-Fluoro-guanosine
  modified_base 17: mod_base = OTHER; note = 2'-O-methyl-adenosine
  modified_base 18: mod_base = OTHER; note = 2'-O-methyl-adenosine
  modified_base 19: mod_base = cm
  modified_base 20: mod_base = OTHER; note = 2'-O-methyl-adenosine
  modified_base 21: mod_base = um
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = OTHER; note = 2'-O-methyl-adenosine
cacctccaaaatactgaacataa

SEQ ID NO: 425 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = cm
  modified_base 4: mod_base = um
  modified_base 5: mod_base = um
  modified_base 6: mod_base = OTHER; note = 2'-Fluoro-uridine
  modified_base 7: mod_base = gm
  modified_base 8: mod_base = OTHER; note = 2'-Fluoro-guanosine
  modified_base 9: mod_base = OTHER; note = 2'-Fluoro-adenosine
  modified_base 10: mod_base = OTHER; note = 2'-O-methyl-adenosine
  modified_base 11: mod_base = OTHER; note = 2'-O-methyl-adenosine
  modified_base 12: mod_base = OTHER; note = 2'-O-methyl-adenosine
  modified_base 13: mod_base = gm
  modified_base 14: mod_base = OTHER; note = 2'-Fluoro-uridine
  modified_base 15: mod_base = cm
  modified_base 16: mod_base = OTHER; note = 2'-Fluoro-adenosine
  modified_base 17: mod_base = gm
  modified_base 18: mod_base = gm
  modified_base 19: mod_base = OTHER; note = 2'-O-methyl-adenosine
  modified_base 20: mod_base = um
  modified_base 21: mod_base = cm
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = gm
cactttggaaaagtcaggatctg

SEQ ID NO: 426 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = um
  modified_base 6: mod_base = OTHER; note = 2'-Fluoro-cytidine
  modified_base 7: mod_base = OTHER; note = 2'-O-methyl-adenosine
  modified_base 8: mod_base = OTHER; note = 2'-Fluoro-adenosine
  modified_base 9: mod_base = OTHER; note = 2'-Fluoro-guanosine
  modified_base 10: mod_base = um
  modified_base 11: mod_base = um
  modified_base 12: mod_base = um
  modified_base 13: mod_base = OTHER; note = 2'-O-methyl-adenosine
  modified_base 14: mod_base = OTHER; note = 2'-Fluoro-cytidine
  modified_base 15: mod_base = OTHER; note = 2'-O-methyl-adenosine
  modified_base 16: mod_base = OTHER; note = 2'-Fluoro-uridine
  modified_base 17: mod_base = OTHER; note = 2'-O-methyl-adenosine
  modified_base 18: mod_base = gm
  modified_base 19: mod_base = cm
  modified_base 20: mod_base = OTHER; note = 2'-O-methyl-adenosine
  modified_base 21: mod_base = um
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = cm
aaattcaagtttacatagcatgc

SEQ ID NO: 427 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = um
  modified_base 6: mod_base = OTHER; note = 2'-Fluoro-guanosine
  modified_base 7: mod_base = um
  modified_base 8: mod_base = OTHER; note = 2'-Fluoro-uridine
  modified_base 9: mod_base = OTHER; note = 2'-Fluoro-guanosine
  modified_base 10: mod_base = um
  modified_base 11: mod_base = um
  modified_base 12: mod_base = um
  modified_base 13: mod_base = OTHER; note = 2'-O-methyl-adenosine
  modified_base 14: mod_base = OTHER; note = 2'-Fluoro-cytidine
  modified_base 15: mod_base = um
  modified_base 16: mod_base = OTHER; note = 2'-Fluoro-uridine
  modified_base 17: mod_base = OTHER; note = 2'-O-methyl-adenosine
  modified_base 18: mod_base = gm
  modified_base 19: mod_base = OTHER; note = 2'-O-methyl-adenosine
  modified_base 20: mod_base = gm
  modified_base 21: mod_base = cm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = gm
aaactgttgtttacttagagcag

SEQ ID NO: 428 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = gm
  modified_base 4: mod_base = um
  modified_base 5: mod_base = OTHER; note = 2'-O-methyl-adenosine
  modified_base 6: mod_base = OTHER; note = 2'-Fluoro-uridine
  modified_base 7: mod_base = cm
  modified_base 8: mod_base = OTHER; note = 2'-Fluoro-uridine
  modified_base 9: mod_base = OTHER; note = 2'-Fluoro-cytidine
  modified_base 10: mod_base = um
  modified_base 11: mod_base = gm
  modified_base 12: mod_base = um
  modified_base 13: mod_base = OTHER; note = 2'-O-methyl-adenosine
  modified_base 14: mod_base = OTHER; note = 2'-Fluoro-cytidine
  modified_base 15: mod_base = OTHER; note = 2'-O-methyl-adenosine
  modified_base 16: mod_base = OTHER; note = 2'-Fluoro-uridine
  modified_base 17: mod_base = cm
  modified_base 18: mod_base = cm
  modified_base 19: mod_base = OTHER; note = 2'-O-methyl-adenosine
  modified_base 20: mod_base = gm
  modified_base 21: mod_base = cm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = cm
gggtatctctgtacatccagcac

SEQ ID NO: 429 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = gm
  modified_base 5: mod_base = um
  modified_base 6: mod_base = OTHER; note = 2'-Fluoro-uridine
  modified_base 7: mod_base = um
  modified_base 8: mod_base = OTHER; note = 2'-Fluoro-adenosine
  modified_base 9: mod_base = OTHER; note = 2'-Fluoro-cytidine
  modified_base 10: mod_base = um
  modified_base 11: mod_base = um
  modified_base 12: mod_base = OTHER; note = 2'-O-methyl-adenosine
  modified_base 13: mod_base = gm
  modified_base 14: mod_base = OTHER; note = 2'-Fluoro-adenosine
  modified_base 15: mod_base = gm
  modified_base 16: mod_base = OTHER; note = 2'-Fluoro-cytidine
  modified_base 17: mod_base = OTHER; note = 2'-O-methyl-adenosine
  modified_base 18: mod_base = gm
  modified_base 19: mod_base = OTHER; note = 2'-O-methyl-adenosine
  modified_base 20: mod_base = gm
  modified_base 21: mod_base = OTHER; note = 2'-O-methyl-adenosine
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = OTHER; note = 2'-O-methyl-adenosine
gttgtttacttagagcagagaca

SEQ ID NO: 430 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = gm
  modified_base 4: mod_base = gm
  modified_base 5: mod_base = OTHER; note = 2'-O-methyl-adenosine
  modified_base 6: mod_base = OTHER; note = 2'-Fluoro-adenosine
  modified_base 7: mod_base = OTHER; note = 2'-O-methyl-adenosine
  modified_base 8: mod_base = OTHER; note = 2'-Fluoro-uridine
  modified_base 9: mod_base = OTHER; note = 2'-Fluoro-uridine
  modified_base 10: mod_base = cm
  modified_base 11: mod_base = OTHER; note = 2'-O-methyl-adenosine
  modified_base 12: mod_base = OTHER; note = 2'-O-methyl-adenosine
  modified_base 13: mod_base = gm
  modified_base 14: mod_base = OTHER; note = 2'-Fluoro-uridine
  modified_base 15: mod_base = um
  modified_base 16: mod_base = OTHER; note = 2'-Fluoro-uridine
  modified_base 17: mod_base = OTHER; note = 2'-O-methyl-adenosine
  modified_base 18: mod_base = cm
  modified_base 19: mod_base = OTHER; note = 2'-O-methyl-adenosine
  modified_base 20: mod_base = um
  modified_base 21: mod_base = OTHER; note = 2'-O-methyl-adenosine
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = cm
taggaaattcaagtttacatagc

SEQ ID NO: 431 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = gm
  modified_base 4: mod_base = um
  modified_base 5: mod_base = cm
  modified_base 6: mod_base = OTHER; note = 2'-Fluoro-cytidine
  modified_base 7: mod_base = OTHER; note = 2'-O-methyl-adenosine
  modified_base 8: mod_base = OTHER; note = 2'-Fluoro-cytidine
  modified_base 9: mod_base = OTHER; note = 2'-Fluoro-uridine
  modified_base 10: mod_base = gm
  modified_base 11: mod_base = um
  modified_base 12: mod_base = gm
  modified_base 13: mod_base = OTHER; note = 2'-O-methyl-adenosine
  modified_base 14: mod_base = OTHER; note = 2'-Fluoro-uridine
  modified_base 15: mod_base = um
  modified_base 16: mod_base = OTHER; note = 2'-Fluoro-uridine
  modified_base 17: mod_base = gm
  modified_base 18: mod_base = gm
  modified_base 19: mod_base = gm
  modified_base 20: mod_base = um
  modified_base 21: mod_base = OTHER; note = 2'-O-methyl-adenosine
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = OTHER; note = 2'-O-methyl-adenosine
atgtccactgtgatttgggtata

SEQ ID NO: 432 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = cm
  modified_base 5: mod_base = gm
  modified_base 6: mod_base = OTHER; note = 2'-Fluoro-guanosine
  modified_base 7: mod_base = um
  modified_base 8: mod_base = OTHER; note = 2'-Fluoro-cytidine
  modified_base 9: mod_base = OTHER; note = 2'-Fluoro-adenosine
  modified_base 10: mod_base = OTHER; note = 2'-O-methyl-adenosine
  modified_base 11: mod_base = OTHER; note = 2'-O-methyl-adenosine
  modified_base 12: mod_base = cm
  modified_base 13: mod_base = cm
  modified_base 14: mod_base = OTHER; note = 2'-Fluoro-uridine
  modified_base 15: mod_base = cm
  modified_base 16: mod_base = OTHER; note = 2'-Fluoro-uridine
  modified_base 17: mod_base = gm
  modified_base 18: mod_base = OTHER; note = 2'-O-methyl-adenosine
  modified_base 19: mod_base = gm
  modified_base 20: mod_base = gm
  modified_base 21: mod_base = OTHER; note = 2'-O-methyl-adenosine
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = um
attcggtcaaacctctgaggatt

SEQ ID NO: 433 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = OTHER; note = 2'-O-methyl-adenosine
  modified_base 6: mod_base = OTHER; note = 2'-Fluoro-cytidine
  modified_base 7: mod_base = OTHER; note = 2'-O-methyl-adenosine
  modified_base 8: mod_base = OTHER; note = 2'-Fluoro-uridine
  modified_base 9: mod_base = OTHER; note = 2'-Fluoro-adenosine
  modified_base 10: mod_base = gm
  modified_base 11: mod_base = gm
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-Fluoro-adenosine
  modified_base 15: mod_base = um
  modified_base 16: mod_base = OTHER; note = 2'-Fluoro-uridine
  modified_base 17: mod_base = cm
  modified_base 18: mod_base = OTHER; note = 2'-O-methyl-adenosine
  modified_base 19: mod_base = OTHER; note = 2'-O-methyl-adenosine
  modified_base 20: mod_base = gm
  modified_base 21: mod_base = um
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = um
aaatacataggaaattcaagttt

SEQ ID NO: 434 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-O-methyl-adenosine
  modified_base 5: mod_base = um
  modified_base 6: mod_base = OTHER; note = 2'-Fluoro-uridine
  modified_base 7: mod_base = OTHER; note = 2'-O-methyl-adenosine
  modified_base 8: mod_base = OTHER; note = 2'-Fluoro-adenosine
  modified_base 9: mod_base = OTHER; note = 2'-Fluoro-adenosine
  modified_base 10: mod_base = OTHER; note = 2'-O-methyl-adenosine
  modified_base 11: mod_base = gm
  modified_base 12: mod_base = gm
  modified_base 13: mod_base = cm
  modified_base 14: mod_base = OTHER; note = 2'-Fluoro-adenosine
  modified_base 15: mod_base = cm
  modified_base 16: mod_base = OTHER; note = 2'-Fluoro-adenosine
  modified_base 17: mod_base = um
  modified_base 18: mod_base = um
  modified_base 19: mod_base = cm
  modified_base 20: mod_base = OTHER; note = 2'-O-methyl-adenosine
  modified_base 21: mod_base = um
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = cm
ctaattaaaaggcacattcatgc

SEQ ID NO: 435 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = cm
  modified_base 6: mod_base = OTHER; note = 2'-Fluoro-uridine
  modified_base 7: mod_base = um
  modified_base 8: mod_base = OTHER; note = 2'-Fluoro-guanosine
  modified_base 9: mod_base = OTHER; note = 2'-Fluoro-uridine
  modified_base 10: mod_base = gm
  modified_base 11: mod_base = OTHER; note = 2'-O-methyl-adenosine
  modified_base 12: mod_base = gm
  modified_base 13: mod_base = gm
  modified_base 14: mod_base = OTHER; note = 2'-Fluoro-adenosine
  modified_base 15: mod_base = gm
  modified_base 16: mod_base = OTHER; note = 2'-Fluoro-adenosine
  modified_base 17: mod_base = gm
  modified_base 18: mod_base = OTHER; note = 2'-O-methyl-adenosine
  modified_base 19: mod_base = cm
  modified_base 20: mod_base = gm
  modified_base 21: mod_base = cm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = gm
ccaccttgtgaggagagacgcag

SEQ ID NO: 436 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = um
  modified_base 4: mod_base = cm
  modified_base 5: mod_base = cm
  modified_base 6: mod_base = OTHER; note = 2'-Fluoro-adenosine
  modified_base 7: mod_base = cm
  modified_base 8: mod_base = OTHER; note = 2'-Fluoro-uridine
  modified_base 9: mod_base = OTHER; note = 2'-Fluoro-guanosine
  modified_base 10: mod_base = um
  modified_base 11: mod_base = gm
  modified_base 12: mod_base = OTHER; note = 2'-O-methyl-adenosine
  modified_base 13: mod_base = um
  modified_base 14: mod_base = OTHER; note = 2'-Fluoro-uridine
  modified_base 15: mod_base = um
  modified_base 16: mod_base = OTHER; note = 2'-Fluoro-guanosine
  modified_base 17: mod_base = gm
  modified_base 18: mod_base = gm
  modified_base 19: mod_base = um
  modified_base 20: mod_base = OTHER; note = 2'-O-methyl-adenosine
  modified_base 21: mod_base = um
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = cm
tgtccactgtgatttgggtatac

SEQ ID NO: 437 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = cm
  modified_base 4: mod_base = OTHER; note = 2'-O-methyl-adenosine
  modified_base 5: mod_base = um
  modified_base 6: mod_base = OTHER; note = 2'-Fluoro-adenosine
  modified_base 7: mod_base = gm
  modified_base 8: mod_base = OTHER; note = 2'-Fluoro-guanosine
  modified_base 9: mod_base = OTHER; note = 2'-Fluoro-adenosine
  modified_base 10: mod_base = OTHER; note = 2'-O-methyl-adenosine
  modified_base 11: mod_base = OTHER; note = 2'-O-methyl-adenosine
  modified_base 12: mod_base = um
  modified_base 13: mod_base = um
  modified_base 14: mod_base = OTHER; note = 2'-Fluoro-cytidine
  modified_base 15: mod_base = OTHER; note = 2'-O-methyl-adenosine
  modified_base 16: mod_base = OTHER; note = 2'-Fluoro-adenosine
  modified_base 17: mod_base = gm
  modified_base 18: mod_base = um
  modified_base 19: mod_base = um
  modified_base 20: mod_base = um
  modified_base 21: mod_base = OTHER; note = 2'-O-methyl-adenosine
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = OTHER; note = 2'-O-methyl-adenosine
tacataggaaattcaagtttaca

SEQ ID NO: 438 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = um
  modified_base 5: mod_base = OTHER; note = 2'-O-methyl-adenosine
  modified_base 6: mod_base = OTHER; note = 2'-Fluoro-cytidine
  modified_base 7: mod_base = OTHER; note = 2'-O-methyl-adenosine
  modified_base 8: mod_base = OTHER; note = 2'-Fluoro-uridine
  modified_base 9: mod_base = OTHER; note = 2'-Fluoro-uridine
  modified_base 10: mod_base = cm
  modified_base 11: mod_base = OTHER; note = 2'-O-methyl-adenosine
  modified_base 12: mod_base = gm
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-uridine
  modified_base 17: mod_base = cm
  modified_base 18: mod_base = OTHER; note = 2'-O-methyl-adenosine
  modified_base 19: mod_base = gm
  modified_base 20: mod_base = OTHER; note = 2'-O-methyl-adenosine
  modified_base 21: mod_base = cm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = OTHER; note = 2'-O-methyl-adenosine
ctttacattcagaaatcagacaa

SEQ ID NO: 439 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-O-methyl-adenosine
  modified_base 5: mod_base = um
  modified_base 6: mod_base = OTHER; note = 2'-Fluoro-adenosine
  modified_base 7: mod_base = OTHER; note = 2'-O-methyl-adenosine
  modified_base 8: mod_base = OTHER; note = 2'-Fluoro-uridine
  modified_base 9: mod_base = OTHER; note = 2'-Fluoro-uridine
  modified_base 10: mod_base = OTHER; note = 2'-O-methyl-adenosine
  modified_base 11: mod_base = um
  modified_base 12: mod_base = um
  modified_base 13: mod_base = OTHER; note = 2'-O-methyl-adenosine
  modified_base 14: mod_base = OTHER; note = 2'-Fluoro-guanosine
  modified_base 15: mod_base = gm
  modified_base 16: mod_base = OTHER; note = 2'-Fluoro-adenosine
  modified_base 17: mod_base = OTHER; note = 2'-O-methyl-adenosine
  modified_base 18: mod_base = OTHER; note = 2'-O-methyl-adenosine
  modified_base 19: mod_base = um
  modified_base 20: mod_base = cm
  modified_base 21: mod_base = cm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = um
ccaataattattaggaaatccat

SEQ ID NO: 440 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = cm
  modified_base 4: mod_base = um
  modified_base 5: mod_base = cm
  modified_base 6: mod_base = OTHER; note = 2'-Fluoro-cytidine
  modified_base 7: mod_base = um
  modified_base 8: mod_base = OTHER; note = 2'-Fluoro-guanosine
  modified_base 9: mod_base = OTHER; note = 2'-Fluoro-cytidine
  modified_base 10: mod_base = cm
  modified_base 11: mod_base = gm
  modified_base 12: mod_base = gm
  modified_base 13: mod_base = um
  modified_base 14: mod_base = OTHER; note = 2'-Fluoro-uridine
  modified_base 15: mod_base = gm
  modified_base 16: mod_base = OTHER; note = 2'-Fluoro-cytidine
  modified_base 17: mod_base = gm
  modified_base 18: mod_base = gm
  modified_base 19: mod_base = OTHER; note = 2'-O-methyl-adenosine
  modified_base 20: mod_base = OTHER; note = 2'-O-methyl-adenosine
  modified_base 21: mod_base = um
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = gm
tgctcctgccggttgcggaatgg

SEQ ID NO: 441 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = gm
  modified_base 4: mod_base = um
  modified_base 5: mod_base = um
  modified_base 6: mod_base = OTHER; note = 2'-Fluoro-uridine
  modified_base 7: mod_base = OTHER; note = 2'-O-methyl-adenosine
  modified_base 8: mod_base = OTHER; note = 2'-Fluoro-cytidine
  modified_base 9: mod_base = OTHER; note = 2'-Fluoro-uridine
  modified_base 10: mod_base = um
  modified_base 11: mod_base = OTHER; note = 2'-O-methyl-adenosine
  modified_base 12: mod_base = gm
  modified_base 13: mod_base = OTHER; note = 2'-O-methyl-adenosine
  modified_base 14: mod_base = OTHER; note = 2'-Fluoro-guanosine
  modified_base 15: mod_base = cm
  modified_base 16: mod_base = OTHER; note = 2'-Fluoro-adenosine
  modified_base 17: mod_base = gm
  modified_base 18: mod_base = OTHER; note = 2'-O-methyl-adenosine
  modified_base 19: mod_base = gm
  modified_base 20: mod_base = OTHER; note = 2'-O-methyl-adenosine
  modified_base 21: mod_base = cm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = cm
ttgtttacttagagcagagacac

SEQ ID NO: 442 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = um
  modified_base 4: mod_base = gm
  modified_base 5: mod_base = um
  modified_base 6: mod_base = OTHER; note = 2'-Fluoro-uridine
  modified_base 7: mod_base = gm
  modified_base 8: mod_base = OTHER; note = 2'-Fluoro-uridine
  modified_base 9: mod_base = OTHER; note = 2'-Fluoro-uridine
  modified_base 10: mod_base = um
  modified_base 11: mod_base = OTHER; note = 2'-O-methyl-adenosine
  modified_base 12: mod_base = cm
  modified_base 13: mod_base = um
  modified_base 14: mod_base = OTHER; note = 2'-Fluoro-uridine
  modified_base 15: mod_base = OTHER; note = 2'-O-methyl-adenosine
  modified_base 16: mod_base = OTHER; note = 2'-Fluoro-guanosine
  modified_base 17: mod_base = OTHER; note = 2'-O-methyl-adenosine
  modified_base 18: mod_base = gm
  modified_base 19: mod_base = cm
  modified_base 20: mod_base = OTHER; note = 2'-O-methyl-adenosine
  modified_base 21: mod_base = gm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = gm
actgttgtttacttagagcagag

SEQ ID NO: 443 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = um
  modified_base 5: mod_base = um
  modified_base 6: mod_base = OTHER; note = 2'-Fluoro-adenosine
  modified_base 7: mod_base = OTHER; note = 2'-O-methyl-adenosine
  modified_base 8: mod_base = OTHER; note = 2'-Fluoro-guanosine
  modified_base 9: mod_base = OTHER; note = 2'-Fluoro-guanosine
  modified_base 10: mod_base = cm
  modified_base 11: mod_base = OTHER; note = 2'-O-methyl-adenosine
  modified_base 12: mod_base = cm
  modified_base 13: mod_base = um
  modified_base 14: mod_base = OTHER; note = 2'-Fluoro-uridine
  modified_base 15: mod_base = um
  modified_base 16: mod_base = OTHER; note = 2'-Fluoro-guanosine
  modified_base 17: mod_base = gm
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = OTHER; note = 2'-O-methyl-adenosine
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = um
cttttaaggcactttggaaaagt

SEQ ID NO: 444 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = cm
  modified_base 4: mod_base = um
  modified_base 5: mod_base = cm
  modified_base 6: mod_base = OTHER; note = 2'-Fluoro-cytidine
  modified_base 7: mod_base = OTHER; note = 2'-O-methyl-adenosine
  modified_base 8: mod_base = OTHER; note = 2'-Fluoro-adenosine
  modified_base 9: mod_base = OTHER; note = 2'-Fluoro-adenosine
  modified_base 10: mod_base = OTHER; note = 2'-O-methyl-adenosine
  modified_base 11: mod_base = um
  modified_base 12: mod_base = OTHER; note = 2'-O-methyl-adenosine
  modified_base 13: mod_base = cm
  modified_base 14: mod_base = OTHER; note = 2'-Fluoro-uridine
  modified_base 15: mod_base = gm
  modified_base 16: mod_base = OTHER; note = 2'-Fluoro-adenosine
  modified_base 17: mod_base = OTHER; note = 2'-O-methyl-adenosine
  modified_base 18: mod_base = cm
  modified_base 19: mod_base = OTHER; note = 2'-O-methyl-adenosine
  modified_base 20: mod_base = um
  modified_base 21: mod_base = OTHER; note = 2'-O-methyl-adenosine
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = gm
acctccaaaatactgaacataag

SEQ ID NO: 445 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = gm
  modified_base 4: mod_base = um
  modified_base 5: mod_base = gm
  modified_base 6: mod_base = OTHER; note = 2'-Fluoro-uridine
  modified_base 7: mod_base = cm
  modified_base 8: mod_base = OTHER; note = 2'-Fluoro-cytidine
  modified_base 9: mod_base = OTHER; note = 2'-Fluoro-cytidine
  modified_base 10: mod_base = gm
  modified_base 11: mod_base = OTHER; note = 2'-O-methyl-adenosine
  modified_base 12: mod_base = um
  modified_base 13: mod_base = gm
  modified_base 14: mod_base = OTHER; note = 2'-Fluoro-uridine
  modified_base 15: mod_base = cm
  modified_base 16: mod_base = OTHER; note = 2'-Fluoro-cytidine
  modified_base 17: mod_base = OTHER; note = 2'-O-methyl-adenosine
  modified_base 18: mod_base = cm
  modified_base 19: mod_base = um
  modified_base 20: mod_base = gm
  modified_base 21: mod_base = um
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = OTHER; note = 2'-O-methyl-adenosine
cggtgtcccgatgtccactgtga

SEQ ID NO: 446 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = cm
  modified_base 4: mod_base = cm
  modified_base 5: mod_base = OTHER; note = 2'-O-methyl-adenosine
  modified_base 6: mod_base = OTHER; note = 2'-Fluoro-adenosine
  modified_base 7: mod_base = um
  modified_base 8: mod_base = OTHER; note = 2'-Fluoro-adenosine
  modified_base 9: mod_base = OTHER; note = 2'-Fluoro-adenosine
  modified_base 10: mod_base = um
  modified_base 11: mod_base = um
  modified_base 12: mod_base = OTHER; note = 2'-O-methyl-adenosine
  modified_base 13: mod_base = um
  modified_base 14: mod_base = OTHER; note = 2'-Fluoro-uridine
  modified_base 15: mod_base = OTHER; note = 2'-O-methyl-adenosine
  modified_base 16: mod_base = OTHER; note = 2'-Fluoro-guanosine
  modified_base 17: mod_base = gm
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = um
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = cm
ccccaataattattaggaaatcc

SEQ ID NO: 447 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = um
  modified_base 4: mod_base = gm
  modified_base 5: mod_base = um
  modified_base 6: mod_base = OTHER; note = 2'-Fluoro-cytidine
  modified_base 7: mod_base = cm
  modified_base 8: mod_base = OTHER; note = 2'-Fluoro-adenosine
  modified_base 9: mod_base = OTHER; note = 2'-Fluoro-cytidine
  modified_base 10: mod_base = um
  modified_base 11: mod_base = gm
  modified_base 12: mod_base = um
  modified_base 13: mod_base = gm
  modified_base 14: mod_base = OTHER; note = 2'-Fluoro-adenosine
  modified_base 15: mod_base = um
  modified_base 16: mod_base = OTHER; note = 2'-Fluoro-uridine
  modified_base 17: mod_base = um
  modified_base 18: mod_base = gm
  modified_base 19: mod_base = gm
  modified_base 20: mod_base = gm
  modified_base 21: mod_base = um
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = um
gatgtccactgtgatttgggtat

SEQ ID NO: 448 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = gm
  modified_base 4: mod_base = OTHER; note = 2'-O-methyl-adenosine
  modified_base 5: mod_base = gm
  modified_base 6: mod_base = OTHER; note = 2'-Fluoro-cytidine
  modified_base 7: mod_base = OTHER; note = 2'-O-methyl-adenosine
  modified_base 8: mod_base = OTHER; note = 2'-Fluoro-guanosine
  modified_base 9: mod_base = OTHER; note = 2'-Fluoro-adenosine
  modified_base 10: mod_base = gm
  modified_base 11: mod_base = OTHER; note = 2'-O-methyl-adenosine
  modified_base 12: mod_base = cm
  modified_base 13: mod_base = OTHER; note = 2'-O-methyl-adenosine
  modified_base 14: mod_base = OTHER; note = 2'-Fluoro-cytidine
  modified_base 15: mod_base = cm
  modified_base 16: mod_base = OTHER; note = 2'-Fluoro-uridine
  modified_base 17: mod_base = cm
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = OTHER; note = 2'-O-methyl-adenosine
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = um
tagagcagagacacctccaaaat

SEQ ID NO: 449 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = gm
  modified_base 4: mod_base = OTHER; note = 2'-O-methyl-adenosine
  modified_base 5: mod_base = um
  modified_base 6: mod_base = OTHER; note = 2'-Fluoro-guanosine
  modified_base 7: mod_base = um
  modified_base 8: mod_base = OTHER; note = 2'-Fluoro-cytidine
  modified_base 9: mod_base = OTHER; note = 2'-Fluoro-cytidine
  modified_base 10: mod_base = OTHER; note = 2'-O-methyl-adenosine
  modified_base 11: mod_base = cm
  modified_base 12: mod_base = um
  modified_base 13: mod_base = gm
  modified_base 14: mod_base = OTHER; note = 2'-Fluoro-uridine
  modified_base 15: mod_base = gm
  modified_base 16: mod_base = OTHER; note = 2'-Fluoro-adenosine
  modified_base 17: mod_base = um
  modified_base 18: mod_base = um
  modified_base 19: mod_base = um
  modified_base 20: mod_base = gm
  modified_base 21: mod_base = gm
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = um
ccgatgtccactgtgatttgggt

SEQ ID NO: 450 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = um
  modified_base 4: mod_base = um
  modified_base 5: mod_base = um
  modified_base 6: mod_base = OTHER; note = 2'-Fluoro-uridine
  modified_base 7: mod_base = OTHER; note = 2'-O-methyl-adenosine
  modified_base 8: mod_base = OTHER; note = 2'-Fluoro-adenosine
  modified_base 9: mod_base = OTHER; note = 2'-Fluoro-guanosine
  modified_base 10: mod_base = gm
  modified_base 11: mod_base = cm
  modified_base 12: mod_base = OTHER; note = 2'-O-methyl-adenosine
  modified_base 13: mod_base = cm
  modified_base 14: mod_base = OTHER; note = 2'-Fluoro-uridine
  modified_base 15: mod_base = um
  modified_base 16: mod_base = OTHER; note = 2'-Fluoro-uridine
  modified_base 17: mod_base = gm
  modified_base 18: mod_base = gm
  modified_base 19: mod_base = OTHER; note = 2'-O-methyl-adenosine
  modified_base 20: mod_base = OTHER; note = 2'-O-methyl-adenosine
  modified_base 21: mod_base = OTHER; note = 2'-O-methyl-adenosine
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = gm
tcttttaaggcactttggaaaag

SEQ ID NO: 451 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = cm
  modified_base 4: mod_base = OTHER; note = 2'-O-methyl-adenosine
  modified_base 5: mod_base = OTHER; note = 2'-O-methyl-adenosine
  modified_base 6: mod_base = OTHER; note = 2'-Fluoro-uridine
  modified_base 7: mod_base = OTHER; note = 2'-O-methyl-adenosine
  modified_base 8: mod_base = OTHER; note = 2'-Fluoro-adenosine
  modified_base 9: mod_base = OTHER; note = 2'-Fluoro-uridine
  modified_base 10: mod_base = um
  modified_base 11: mod_base = OTHER; note = 2'-O-methyl-adenosine
  modified_base 12: mod_base = um
  modified_base 13: mod_base = um
  modified_base 14: mod_base = OTHER; note = 2'-Fluoro-adenosine
  modified_base 15: mod_base = gm
  modified_base 16: mod_base = OTHER; note = 2'-Fluoro-guanosine
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20: mod_base = um
  modified_base 21: mod_base = cm
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = OTHER; note = 2'-O-methyl-adenosine
cccaataattattaggaaatcca

SEQ ID NO: 452 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = cm
  modified_base 4: mod_base = cm
  modified_base 5: mod_base = OTHER; note = 2'-O-methyl-adenosine
  modified_base 6: mod_base = OTHER; note = 2'-Fluoro-cytidine
  modified_base 7: mod_base = um
  modified_base 8: mod_base = OTHER; note = 2'-Fluoro-guanosine
  modified_base 9: mod_base = OTHER; note = 2'-Fluoro-uridine
  modified_base 10: mod_base = gm
  modified_base 11: mod_base = OTHER; note = 2'-O-methyl-adenosine
  modified_base 12: mod_base = um
  modified_base 13: mod_base = um
  modified_base 14: mod_base = OTHER; note = 2'-Fluoro-uridine
  modified_base 15: mod_base = gm
  modified_base 16: mod_base = OTHER; note = 2'-Fluoro-guanosine
  modified_base 17: mod_base = gm
  modified_base 18: mod_base = um
  modified_base 19: mod_base = OTHER; note = 2'-O-methyl-adenosine
  modified_base 20: mod_base = um
  modified_base 21: mod_base = OTHER; note = 2'-O-methyl-adenosine
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = OTHER; note = 2'-O-methyl-adenosine
gtccactgtgatttgggtataca

SEQ ID NO: 453 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = gm
  modified_base 5: mod_base = gm
  modified_base 6: mod_base = OTHER; note = 2'-Fluoro-uridine
  modified_base 7: mod_base = gm
  modified_base 8: mod_base = OTHER; note = 2'-Fluoro-adenosine
  modified_base 9: mod_base = OTHER; note = 2'-Fluoro-guanosine
  modified_base 10: mod_base = um
  modified_base 11: mod_base = gm
  modified_base 12: mod_base = OTHER; note = 2'-O-methyl-adenosine
  modified_base 13: mod_base = gm
  modified_base 14: mod_base = OTHER; note = 2'-Fluoro-uridine
  modified_base 15: mod_base = um
  modified_base 16: mod_base = OTHER; note = 2'-Fluoro-cytidine
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20: mod_base = cm
  modified_base 21: mod_base = cm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = um
gtaggtgagtgagttcaaaccat

SEQ ID NO: 454 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = um
  modified_base 4: mod_base = um
  modified_base 5: mod_base = OTHER; note = 2'-O-methyl-adenosine
  modified_base 6: mod_base = OTHER; note = 2'-Fluoro-guanosine
  modified_base 7: mod_base = OTHER; note = 2'-O-methyl-adenosine
  modified_base 8: mod_base = OTHER; note = 2'-Fluoro-guanosine
  modified_base 9: mod_base = OTHER; note = 2'-Fluoro-cytidine
  modified_base 10: mod_base = OTHER; note = 2'-O-methyl-adenosine
  modified_base 11: mod_base = gm
  modified_base 12: mod_base = OTHER; note = 2'-O-methyl-adenosine
  modified_base 13: mod_base = gm
  modified_base 14: mod_base = OTHER; note = 2'-Fluoro-adenosine
  modified_base 15: mod_base = cm
  modified_base 16: mod_base = OTHER; note = 2'-Fluoro-adenosine
  modified_base 17: mod_base = cm
  modified_base 18: mod_base = cm
  modified_base 19: mod_base = um
  modified_base 20: mod_base = cm
  modified_base 21: mod_base = cm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = OTHER; note = 2'-O-methyl-adenosine
acttagagcagagacacctccaa

SEQ ID NO: 455 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = cm
  modified_base 4: mod_base = cm
  modified_base 5: mod_base = um
  modified_base 6: mod_base = OTHER; note = 2'-Fluoro-uridine
  modified_base 7: mod_base = gm
  modified_base 8: mod_base = OTHER; note = 2'-Fluoro-uridine
  modified_base 9: mod_base = OTHER; note = 2'-Fluoro-guanosine
  modified_base 10: mod_base = OTHER; note = 2'-O-methyl-adenosine
  modified_base 11: mod_base = gm
  modified_base 12: mod_base = gm
  modified_base 13: mod_base = OTHER; note = 2'-O-methyl-adenosine
  modified_base 14: mod_base = OTHER; note = 2'-Fluoro-guanosine
  modified_base 15: mod_base = OTHER; note = 2'-O-methyl-adenosine
  modified_base 16: mod_base = OTHER; note = 2'-Fluoro-guanosine
  modified_base 17: mod_base = OTHER; note = 2'-O-methyl-adenosine
  modified_base 18: mod_base = cm
  modified_base 19: mod_base = gm
  modified_base 20: mod_base = cm
  modified_base 21: mod_base = OTHER; note = 2'-O-methyl-adenosine
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = um
caccttgtgaggagagacgcagt

SEQ ID NO: 456 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-O-methyl-adenosine
  modified_base 5: mod_base = um
  modified_base 6: mod_base = OTHER; note = 2'-Fluoro-guanosine
  modified_base 7: mod_base = um
  modified_base 8: mod_base = OTHER; note = 2'-Fluoro-cytidine
  modified_base 9: mod_base = OTHER; note = 2'-Fluoro-adenosine
  modified_base 10: mod_base = um
  modified_base 11: mod_base = cm
  modified_base 12: mod_base = OTHER; note = 2'-O-methyl-adenosine
  modified_base 13: mod_base = um
  modified_base 14: mod_base = OTHER; note = 2'-Fluoro-cytidine
  modified_base 15: mod_base = um
  modified_base 16: mod_base = OTHER; note = 2'-Fluoro-uridine
  modified_base 17: mod_base = cm
  modified_base 18: mod_base = um
  modified_base 19: mod_base = cm
  modified_base 20: mod_base = cm
  modified_base 21: mod_base = um
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = cm
aaaatgtcatcatcttctcctcc

SEQ ID NO: 457 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = OTHER; note = 2'-O-methyl-adenosine
  modified_base 5: mod_base = gm
  modified_base 6: mod_base = OTHER; note = 2'-Fluoro-adenosine
  modified_base 7: mod_base = gm
  modified_base 8: mod_base = OTHER; note = 2'-Fluoro-cytidine
  modified_base 9: mod_base = OTHER; note = 2'-Fluoro-adenosine
  modified_base 10: mod_base = gm
  modified_base 11: mod_base = OTHER; note = 2'-O-methyl-adenosine
  modified_base 12: mod_base = gm
  modified_base 13: mod_base = OTHER; note = 2'-O-methyl-adenosine
  modified_base 14: mod_base = OTHER; note = 2'-Fluoro-cytidine
  modified_base 15: mod_base = OTHER; note = 2'-O-methyl-adenosine
  modified_base 16: mod_base = OTHER; note = 2'-Fluoro-cytidine
  modified_base 17: mod_base = cm
  modified_base 18: mod_base = um
  modified_base 19: mod_base = cm
  modified_base 20: mod_base = cm
  modified_base 21: mod_base = OTHER; note = 2'-O-methyl-adenosine
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = OTHER; note = 2'-O-methyl-adenosine
cttagagcagagacacctccaaa

SEQ ID NO: 458 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = um
  modified_base 4: mod_base = cm
  modified_base 5: mod_base = cm
  modified_base 6: mod_base = OTHER; note = 2'-Fluoro-uridine
  modified_base 7: mod_base = cm
  modified_base 8: mod_base = OTHER; note = 2'-Fluoro-cytidine
  modified_base 9: mod_base = OTHER; note = 2'-Fluoro-cytidine
  modified_base 10: mod_base = cm
  modified_base 11: mod_base = OTHER; note = 2'-O-methyl-adenosine
  modified_base 12: mod_base = gm
  modified_base 13: mod_base = cm
  modified_base 14: mod_base = OTHER; note = 2'-Fluoro-cytidine
  modified_base 15: mod_base = cm
  modified_base 16: mod_base = OTHER; note = 2'-Fluoro-cytidine
  modified_base 17: mod_base = OTHER; note = 2'-O-methyl-adenosine
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = OTHER; note = 2'-O-methyl-adenosine
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = um
tctcctccccagccccaataatt

SEQ ID NO: 459 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = gm
  modified_base 4: mod_base = cm
  modified_base 5: mod_base = OTHER; note = 2'-O-methyl-adenosine
  modified_base 6: mod_base = OTHER; note = 2'-Fluoro-cytidine
  modified_base 7: mod_base = um
  modified_base 8: mod_base = OTHER; note = 2'-Fluoro-uridine
  modified_base 9: mod_base = OTHER; note = 2'-Fluoro-uridine
  modified_base 10: mod_base = gm
  modified_base 11: mod_base = gm
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-guanosine
  modified_base 17: mod_base = um
  modified_base 18: mod_base = cm
  modified_base 19: mod_base = OTHER; note = 2'-O-methyl-adenosine
  modified_base 20: mod_base = gm
  modified_base 21: mod_base = gm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = um
aggcactttggaaaagtcaggat

SEQ ID NO: 460 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = um
  modified_base 6: mod_base = OTHER; note = 2'-Fluoro-guanosine
  modified_base 7: mod_base = cm
  modified_base 8: mod_base = OTHER; note = 2'-Fluoro-adenosine
  modified_base 9: mod_base = OTHER; note = 2'-Fluoro-adenosine
  modified_base 10: mod_base = cm
  modified_base 11: mod_base = gm
  modified_base 12: mod_base = gm
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-uridine
  modified_base 17: mod_base = gm
  modified_base 18: mod_base = um
  modified_base 19: mod_base = gm
  modified_base 20: mod_base = cm
  modified_base 21: mod_base = cm
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = um
ccattgcaacggaaatgtgccgt

SEQ ID NO: 461 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = cm
  modified_base 4: mod_base = um
  modified_base 5: mod_base = gm
  modified_base 6: mod_base = OTHER; note = 2'-Fluoro-uridine
  modified_base 7: mod_base = um
  modified_base 8: mod_base = OTHER; note = 2'-Fluoro-guanosine
  modified_base 9: mod_base = OTHER; note = 2'-Fluoro-uridine
  modified_base 10: mod_base = um
  modified_base 11: mod_base = um
  modified_base 12: mod_base = OTHER; note = 2'-O-methyl-adenosine
  modified_base 13: mod_base = cm
  modified_base 14: mod_base = OTHER; note = 2'-Fluoro-uridine
  modified_base 15: mod_base = um
  modified_base 16: mod_base = OTHER; note = 2'-Fluoro-adenosine
  modified_base 17: mod_base = gm
  modified_base 18: mod_base = OTHER; note = 2'-O-methyl-adenosine
  modified_base 19: mod_base = gm
  modified_base 20: mod_base = cm
  modified_base 21: mod_base = OTHER; note = 2'-O-methyl-adenosine
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = OTHER; note = 2'-O-methyl-adenosine
aactgttgtttacttagagcaga

SEQ ID NO: 462 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = gm
  modified_base 5: mod_base = OTHER; note = 2'-O-methyl-adenosine
  modified_base 6: mod_base = OTHER; note = 2'-Fluoro-guanosine
  modified_base 7: mod_base = cm
  modified_base 8: mod_base = OTHER; note = 2'-Fluoro-adenosine
  modified_base 9: mod_base = OTHER; note = 2'-Fluoro-guanosine
  modified_base 10: mod_base = OTHER; note = 2'-O-methyl-adenosine
  modified_base 11: mod_base = gm
  modified_base 12: mod_base = OTHER; note = 2'-O-methyl-adenosine
  modified_base 13: mod_base = cm
  modified_base 14: mod_base = OTHER; note = 2'-Fluoro-adenosine
  modified_base 15: mod_base = cm
  modified_base 16: mod_base = OTHER; note = 2'-Fluoro-cytidine
  modified_base 17: mod_base = um
  modified_base 18: mod_base = cm
  modified_base 19: mod_base = cm
  modified_base 20: mod_base = OTHER; note = 2'-O-methyl-adenosine
  modified_base 21: mod_base = OTHER; note = 2'-O-methyl-adenosine
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = OTHER; note = 2'-O-methyl-adenosine
ttagagcagagacacctccaaaa

SEQ ID NO: 463 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-O-methyl-adenosine
  modified_base 5: mod_base = um
  modified_base 6: mod_base = OTHER; note = 2'-Fluoro-uridine
  modified_base 7: mod_base = cm
  modified_base 8: mod_base = OTHER; note = 2'-Fluoro-adenosine
  modified_base 9: mod_base = OTHER; note = 2'-Fluoro-adenosine
  modified_base 10: mod_base = gm
  modified_base 11: mod_base = um
  modified_base 12: mod_base = um
  modified_base 13: mod_base = um
  modified_base 14: mod_base = OTHER; note = 2'-Fluoro-adenosine
  modified_base 15: mod_base = cm
  modified_base 16: mod_base = OTHER; note = 2'-Fluoro-adenosine
  modified_base 17: mod_base = um
  modified_base 18: mod_base = OTHER; note = 2'-O-methyl-adenosine
  modified_base 19: mod_base = gm
  modified_base 20: mod_base = cm
  modified_base 21: mod_base = OTHER; note = 2'-O-methyl-adenosine
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = gm
gaaattcaagtttacatagcatg

SEQ ID NO: 464 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = OTHER; note = 2'-O-methyl-adenosine
  modified_base 6: mod_base = OTHER; note = 2'-Fluoro-adenosine
  modified_base 7: mod_base = um
  modified_base 8: mod_base = OTHER; note = 2'-Fluoro-uridine
  modified_base 9: mod_base = OTHER; note = 2'-Fluoro-adenosine
  modified_base 10: mod_base = um
  modified_base 11: mod_base = um
  modified_base 12: mod_base = OTHER; note = 2'-O-methyl-adenosine
  modified_base 13: mod_base = gm
  modified_base 14: mod_base = OTHER; note = 2'-Fluoro-guanosine
  modified_base 15: mod_base = OTHER; note = 2'-O-methyl-adenosine
  modified_base 16: mod_base = OTHER; note = 2'-Fluoro-adenosine
  modified_base 17: mod_base = OTHER; note = 2'-O-methyl-adenosine
  modified_base 18: mod_base = um
  modified_base 19: mod_base = cm
  modified_base 20: mod_base = cm
  modified_base 21: mod_base = OTHER; note = 2'-O-methyl-adenosine
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = um
caataattattaggaaatccatt

SEQ ID NO: 465 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = cm
  modified_base 4: mod_base = cm
  modified_base 5: mod_base = um
  modified_base 6: mod_base = OTHER; note = 2'-Fluoro-cytidine
  modified_base 7: mod_base = cm
  modified_base 8: mod_base = OTHER; note = 2'-Fluoro-cytidine
  modified_base 9: mod_base = OTHER; note = 2'-Fluoro-cytidine
  modified_base 10: mod_base = OTHER; note = 2'-O-methyl-adenosine
  modified_base 11: mod_base = gm
  modified_base 12: mod_base = cm
  modified_base 13: mod_base = cm
  modified_base 14: mod_base = OTHER; note = 2'-Fluoro-cytidine
  modified_base 15: mod_base = cm
  modified_base 16: mod_base = OTHER; note = 2'-Fluoro-adenosine
  modified_base 17: mod_base = OTHER; note = 2'-O-methyl-adenosine
  modified_base 18: mod_base = um
  modified_base 19: mod_base = OTHER; note = 2'-O-methyl-adenosine
  modified_base 20: mod_base = OTHER; note = 2'-O-methyl-adenosine
  modified_base 21: mod_base = um
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = OTHER; note = 2'-O-methyl-adenosine
ctcctccccagccccaataatta

SEQ ID NO: 466 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = um
  modified_base 5: mod_base = OTHER; note = 2'-O-methyl-adenosine
  modified_base 6: mod_base = OTHER; note = 2'-Fluoro-adenosine
  modified_base 7: mod_base = gm
  modified_base 8: mod_base = OTHER; note = 2'-Fluoro-guanosine
  modified_base 9: mod_base = OTHER; note = 2'-Fluoro-cytidine
  modified_base 10: mod_base = OTHER; note = 2'-O-methyl-adenosine
  modified_base 11: mod_base = cm
  modified_base 12: mod_base = um
  modified_base 13: mod_base = um
  modified_base 14: mod_base = OTHER; note = 2'-Fluoro-uridine
  modified_base 15: mod_base = gm
  modified_base 16: mod_base = OTHER; note = 2'-Fluoro-guanosine
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = cm
ttttaaggcactttggaaaagtc

SEQ ID NO: 467 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = cm
  modified_base 4: mod_base = um
  modified_base 5: mod_base = cm
  modified_base 6: mod_base = OTHER; note = 2'-Fluoro-cytidine
  modified_base 7: mod_base = um
  modified_base 8: mod_base = OTHER; note = 2'-Fluoro-cytidine
  modified_base 9: mod_base = OTHER; note = 2'-Fluoro-cytidine
  modified_base 10: mod_base = cm
  modified_base 11: mod_base = cm
  modified_base 12: mod_base = OTHER; note = 2'-O-methyl-adenosine
  modified_base 13: mod_base = gm
  modified_base 14: mod_base = OTHER; note = 2'-Fluoro-cytidine
  modified_base 15: mod_base = cm
  modified_base 16: mod_base = OTHER; note = 2'-Fluoro-cytidine
  modified_base 17: mod_base = cm
  modified_base 18: mod_base = OTHER; note = 2'-O-methyl-adenosine
  modified_base 19: mod_base = OTHER; note = 2'-O-methyl-adenosine
  modified_base 20: mod_base = um
  modified_base 21: mod_base = OTHER; note = 2'-O-methyl-adenosine
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = um
ttctcctccccagccccaataat

SEQ ID NO: 468 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = gm
  modified_base 5: mod_base = cm
  modified_base 6: mod_base = OTHER; note = 2'-Fluoro-uridine
  modified_base 7: mod_base = cm
  modified_base 8: mod_base = OTHER; note = 2'-Fluoro-guanosine
  modified_base 9: mod_base = OTHER; note = 2'-Fluoro-guanosine
  modified_base 10: mod_base = um
  modified_base 11: mod_base = gm
  modified_base 12: mod_base = um
  modified_base 13: mod_base = cm
  modified_base 14: mod_base = OTHER; note = 2'-Fluoro-cytidine
  modified_base 15: mod_base = cm
  modified_base 16: mod_base = OTHER; note = 2'-Fluoro-guanosine
  modified_base 17: mod_base = OTHER; note = 2'-O-methyl-adenosine
  modified_base 18: mod_base = um
  modified_base 19: mod_base = gm
  modified_base 20: mod_base = um
  modified_base 21: mod_base = cm
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = OTHER; note = 2'-O-methyl-adenosine
ctagctcggtgtcccgatgtcca

SEQ ID NO: 469 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = OTHER; note = 2'-O-methyl-adenosine
  modified_base 6: mod_base = OTHER; note = 2'-Fluoro-cytidine
  modified_base 7: mod_base = cm
  modified_base 8: mod_base = OTHER; note = 2'-Fluoro-uridine
  modified_base 9: mod_base = OTHER; note = 2'-Fluoro-cytidine
  modified_base 10: mod_base = cm
  modified_base 11: mod_base = OTHER; note = 2'-O-methyl-adenosine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-Fluoro-adenosine
  modified_base 15: mod_base = um
  modified_base 16: mod_base = OTHER; note = 2'-Fluoro-adenosine
  modified_base 17: mod_base = cm
  modified_base 18: mod_base = um
  modified_base 19: mod_base = gm
  modified_base 20: mod_base = OTHER; note = 2'-O-methyl-adenosine
  modified_base 21: mod_base = OTHER; note = 2'-O-methyl-adenosine
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = OTHER; note = 2'-O-methyl-adenosine
agacacctccaaaatactgaaca

SEQ ID NO: 470 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = cm
  modified_base 4: mod_base = um
  modified_base 5: mod_base = um
  modified_base 6: mod_base = OTHER; note = 2'-Fluoro-adenosine
  modified_base 7: mod_base = gm
  modified_base 8: mod_base = OTHER; note = 2'-Fluoro-adenosine
  modified_base 9: mod_base = OTHER; note = 2'-Fluoro-guanosine
  modified_base 10: mod_base = cm
  modified_base 11: mod_base = OTHER; note = 2'-O-methyl-adenosine
  modified_base 12: mod_base = gm
  modified_base 13: mod_base = OTHER; note = 2'-O-methyl-adenosine
  modified_base 14: mod_base = OTHER; note = 2'-Fluoro-guanosine
  modified_base 15: mod_base = OTHER; note = 2'-O-methyl-adenosine
  modified_base 16: mod_base = OTHER; note = 2'-Fluoro-cytidine
  modified_base 17: mod_base = OTHER; note = 2'-O-methyl-adenosine
  modified_base 18: mod_base = cm
  modified_base 19: mod_base = cm
  modified_base 20: mod_base = um
  modified_base 21: mod_base = cm
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = OTHER; note = 2'-O-methyl-adenosine
tacttagagcagagacacctcca

SEQ ID NO: 471 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = gm
  modified_base 4: mod_base = gm
  modified_base 5: mod_base = um
  modified_base 6: mod_base = OTHER; note = 2'-Fluoro-guanosine
  modified_base 7: mod_base = OTHER; note = 2'-O-methyl-adenosine
  modified_base 8: mod_base = OTHER; note = 2'-Fluoro-guanosine
  modified_base 9: mod_base = OTHER; note = 2'-Fluoro-uridine
  modified_base 10: mod_base = gm
  modified_base 11: mod_base = OTHER; note = 2'-O-methyl-adenosine
  modified_base 12: mod_base = gm
  modified_base 13: mod_base = um
  modified_base 14: mod_base = OTHER; note = 2'-Fluoro-uridine
  modified_base 15: mod_base = cm
  modified_base 16: mod_base = OTHER; note = 2'-Fluoro-adenosine
  modified_base 17: mod_base = OTHER; note = 2'-O-methyl-adenosine
  modified_base 18: mod_base = OTHER; note = 2'-O-methyl-adenosine
  modified_base 19: mod_base = cm
  modified_base 20: mod_base = cm
  modified_base 21: mod_base = OTHER; note = 2'-O-methyl-adenosine
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = cm
taggtgagtgagttcaaaccatc

SEQ ID NO: 472 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = um
  modified_base 4: mod_base = um
  modified_base 5: mod_base = um
  modified_base 6: mod_base = OTHER; note = 2'-Fluoro-adenosine
  modified_base 7: mod_base = cm
  modified_base 8: mod_base = OTHER; note = 2'-Fluoro-adenosine
  modified_base 9: mod_base = OTHER; note = 2'-Fluoro-uridine
  modified_base 10: mod_base = um
  modified_base 11: mod_base = cm
  modified_base 12: mod_base = OTHER; note = 2'-O-methyl-adenosine
  modified_base 13: mod_base = gm
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-adenosine
  modified_base 17: mod_base = um
  modified_base 18: mod_base = cm
  modified_base 19: mod_base = OTHER; note = 2'-O-methyl-adenosine
  modified_base 20: mod_base = gm
  modified_base 21: mod_base = OTHER; note = 2'-O-methyl-adenosine
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = OTHER; note = 2'-O-methyl-adenosine
actttacattcagaaatcagaca

SEQ ID NO: 473 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = um
  modified_base 4: mod_base = OTHER; note = 2'-O-methyl-adenosine
  modified_base 5: mod_base = gm
  modified_base 6: mod_base = OTHER; note = 2'-Fluoro-guanosine
  modified_base 7: mod_base = OTHER; note = 2'-O-methyl-adenosine
  modified_base 8: mod_base = OTHER; note = 2'-Fluoro-adenosine
  modified_base 9: mod_base = OTHER; note = 2'-Fluoro-adenosine
  modified_base 10: mod_base = um
  modified_base 11: mod_base = um
  modified_base 12: mod_base = cm
  modified_base 13: mod_base = OTHER; note = 2'-O-methyl-adenosine
  modified_base 14: mod_base = OTHER; note = 2'-Fluoro-adenosine
  modified_base 15: mod_base = gm
  modified_base 16: mod_base = OTHER; note = 2'-Fluoro-uridine
  modified_base 17: mod_base = um
  modified_base 18: mod_base = um
  modified_base 19: mod_base = OTHER; note = 2'-O-methyl-adenosine
  modified_base 20: mod_base = cm
  modified_base 21: mod_base = OTHER; note = 2'-O-methyl-adenosine
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = OTHER; note = 2'-O-methyl-adenosine
cataggaaattcaagtttacata

SEQ ID NO: 474 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = um
  modified_base 5: mod_base = OTHER; note = 2'-O-methyl-adenosine
  modified_base 6: mod_base = OTHER; note = 2'-Fluoro-cytidine
  modified_base 7: mod_base = um
  modified_base 8: mod_base = OTHER; note = 2'-Fluoro-uridine
  modified_base 9: mod_base = OTHER; note = 2'-Fluoro-adenosine
  modified_base 10: mod_base = gm
  modified_base 11: mod_base = OTHER; note = 2'-O-methyl-adenosine
  modified_base 12: mod_base = gm
  modified_base 13: mod_base = cm
  modified_base 14: mod_base = OTHER; note = 2'-Fluoro-adenosine
  modified_base 15: mod_base = gm
  modified_base 16: mod_base = OTHER; note = 2'-Fluoro-adenosine
  modified_base 17: mod_base = gm
  modified_base 18: mod_base = OTHER; note = 2'-O-methyl-adenosine
  modified_base 19: mod_base = cm
  modified_base 20: mod_base = OTHER; note = 2'-O-methyl-adenosine
  modified_base 21: mod_base = cm
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = um
gtttacttagagcagagacacct

SEQ ID NO: 475 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = cm
  modified_base 4: mod_base = um
  modified_base 5: mod_base = um
  modified_base 6: mod_base = OTHER; note = 2'-Fluoro-guanosine
  modified_base 7: mod_base = um
  modified_base 8: mod_base = OTHER; note = 2'-Fluoro-guanosine
  modified_base 9: mod_base = OTHER; note = 2'-Fluoro-adenosine
  modified_base 10: mod_base = gm
  modified_base 11: mod_base = gm
  modified_base 12: mod_base = OTHER; note = 2'-O-methyl-adenosine
  modified_base 13: mod_base = gm
  modified_base 14: mod_base = OTHER; note = 2'-Fluoro-adenosine
  modified_base 15: mod_base = gm
  modified_base 16: mod_base = OTHER; note = 2'-Fluoro-adenosine
  modified_base 17: mod_base = cm
  modified_base 18: mod_base = gm
  modified_base 19: mod_base = cm
  modified_base 20: mod_base = OTHER; note = 2'-O-methyl-adenosine
  modified_base 21: mod_base = gm
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = cm
accttgtgaggagagacgcagtc

SEQ ID NO: 476 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = um
  modified_base 4: mod_base = cm
  modified_base 5: mod_base = cm
  modified_base 6: mod_base = OTHER; note = 2'-Fluoro-adenosine
  modified_base 7: mod_base = OTHER; note = 2'-O-methyl-adenosine
  modified_base 8: mod_base = OTHER; note = 2'-Fluoro-adenosine
  modified_base 9: mod_base = OTHER; note = 2'-Fluoro-adenosine
  modified_base 10: mod_base = um
  modified_base 11: mod_base = OTHER; note = 2'-O-methyl-adenosine
  modified_base 12: mod_base = cm
  modified_base 13: mod_base = um
  modified_base 14: mod_base = OTHER; note = 2'-Fluoro-guanosine
  modified_base 15: mod_base = OTHER; note = 2'-O-methyl-adenosine
  modified_base 16: mod_base = OTHER; note = 2'-Fluoro-adenosine
  modified_base 17: mod_base = cm
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = OTHER; note = 2'-O-methyl-adenosine
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = gm
cctccaaaatactgaacataagg

SEQ ID NO: 477 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = um
  modified_base 4: mod_base = gm
  modified_base 5: mod_base = um
  modified_base 6: mod_base = OTHER; note = 2'-Fluoro-cytidine
  modified_base 7: mod_base = cm
  modified_base 8: mod_base = OTHER; note = 2'-Fluoro-cytidine
  modified_base 9: mod_base = OTHER; note = 2'-Fluoro-guanosine
  modified_base 10: mod_base = OTHER; note = 2'-O-methyl-adenosine
  modified_base 11: mod_base = um
  modified_base 12: mod_base = gm
  modified_base 13: mod_base = um
  modified_base 14: mod_base = OTHER; note = 2'-Fluoro-cytidine
  modified_base 15: mod_base = cm
  modified_base 16: mod_base = OTHER; note = 2'-Fluoro-adenosine
  modified_base 17: mod_base = cm
  modified_base 18: mod_base = um
  modified_base 19: mod_base = gm
  modified_base 20: mod_base = um
  modified_base 21: mod_base = gm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = um
ggtgtcccgatgtccactgtgat

SEQ ID NO: 478 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = gm
  modified_base 4: mod_base = um
  modified_base 5: mod_base = um
  modified_base 6: mod_base = OTHER; note = 2'-Fluoro-guanosine
  modified_base 7: mod_base = um
  modified_base 8: mod_base = OTHER; note = 2'-Fluoro-uridine
  modified_base 9: mod_base = OTHER; note = 2'-Fluoro-uridine
  modified_base 10: mod_base = OTHER; note = 2'-O-methyl-adenosine
  modified_base 11: mod_base = cm
  modified_base 12: mod_base = um
  modified_base 13: mod_base = um
  modified_base 14: mod_base = OTHER; note = 2'-Fluoro-adenosine
  modified_base 15: mod_base = gm
  modified_base 16: mod_base = OTHER; note = 2'-Fluoro-adenosine
  modified_base 17: mod_base = gm
  modified_base 18: mod_base = cm
  modified_base 19: mod_base = OTHER; note = 2'-O-methyl-adenosine
  modified_base 20: mod_base = gm
  modified_base 21: mod_base = OTHER; note = 2'-O-methyl-adenosine
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = OTHER; note = 2'-O-methyl-adenosine
ctgttgtttacttagagcagaga

SEQ ID NO: 479 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = um
  modified_base 4: mod_base = um
  modified_base 5: mod_base = gm
  modified_base 6: mod_base = OTHER; note = 2'-Fluoro-cytidine
  modified_base 7: mod_base = OTHER; note = 2'-O-methyl-adenosine
  modified_base 8: mod_base = OTHER; note = 2'-Fluoro-adenosine
  modified_base 9: mod_base = OTHER; note = 2'-Fluoro-cytidine
  modified_base 10: mod_base = gm
  modified_base 11: mod_base = gm
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-Fluoro-adenosine
  modified_base 15: mod_base = um
  modified_base 16: mod_base = OTHER; note = 2'-Fluoro-guanosine
  modified_base 17: mod_base = um
  modified_base 18: mod_base = gm
  modified_base 19: mod_base = cm
  modified_base 20: mod_base = cm
  modified_base 21: mod_base = gm
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = gm
cattgcaacggaaatgtgccgtg

SEQ ID NO: 480 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = gm
  modified_base 4: mod_base = OTHER; note = 2'-O-methyl-adenosine
  modified_base 5: mod_base = cm
  modified_base 6: mod_base = OTHER; note = 2'-Fluoro-adenosine
  modified_base 7: mod_base = cm
  modified_base 8: mod_base = OTHER; note = 2'-Fluoro-cytidine
  modified_base 9: mod_base = OTHER; note = 2'-Fluoro-uridine
  modified_base 10: mod_base = cm
  modified_base 11: mod_base = cm
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-uridine
  modified_base 17: mod_base = OTHER; note = 2'-O-methyl-adenosine
  modified_base 18: mod_base = cm
  modified_base 19: mod_base = um
  modified_base 20: mod_base = gm
  modified_base 21: mod_base = OTHER; note = 2'-O-methyl-adenosine
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = cm
gagacacctccaaaatactgaac

SEQ ID NO: 481 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = cm
  modified_base 4: mod_base = OTHER; note = 2'-O-methyl-adenosine
  modified_base 5: mod_base = um
  modified_base 6: mod_base = OTHER; note = 2'-Fluoro-uridine
  modified_base 7: mod_base = gm
  modified_base 8: mod_base = OTHER; note = 2'-Fluoro-cytidine
  modified_base 9: mod_base = OTHER; note = 2'-Fluoro-adenosine
  modified_base 10: mod_base = OTHER; note = 2'-O-methyl-adenosine
  modified_base 11: mod_base = cm
  modified_base 12: mod_base = gm
  modified_base 13: mod_base = gm
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-adenosine
  modified_base 17: mod_base = um
  modified_base 18: mod_base = gm
  modified_base 19: mod_base = um
  modified_base 20: mod_base = gm
  modified_base 21: mod_base = cm
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = gm
tccattgcaacggaaatgtgccg

SEQ ID NO: 482 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = um
  modified_base 4: mod_base = um
  modified_base 5: mod_base = cm
  modified_base 6: mod_base = OTHER; note = 2'-Fluoro-adenosine
  modified_base 7: mod_base = OTHER; note = 2'-O-methyl-adenosine
  modified_base 8: mod_base = OTHER; note = 2'-Fluoro-guanosine
  modified_base 9: mod_base = OTHER; note = 2'-Fluoro-uridine
  modified_base 10: mod_base = um
  modified_base 11: mod_base = um
  modified_base 12: mod_base = OTHER; note = 2'-O-methyl-adenosine
  modified_base 13: mod_base = cm
  modified_base 14: mod_base = OTHER; note = 2'-Fluoro-adenosine
  modified_base 15: mod_base = um
  modified_base 16: mod_base = OTHER; note = 2'-Fluoro-adenosine
  modified_base 17: mod_base = gm
  modified_base 18: mod_base = cm
  modified_base 19: mod_base = OTHER; note = 2'-O-methyl-adenosine
  modified_base 20: mod_base = um
  modified_base 21: mod_base = gm
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = cm
aattcaagtttacatagcatgcc

SEQ ID NO: 483 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = cm
  modified_base 4: mod_base = gm
  modified_base 5: mod_base = gm
  modified_base 6: mod_base = OTHER; note = 2'-Fluoro-uridine
  modified_base 7: mod_base = cm
  modified_base 8: mod_base = OTHER; note = 2'-Fluoro-adenosine
  modified_base 9: mod_base = OTHER; note = 2'-Fluoro-adenosine
  modified_base 10: mod_base = OTHER; note = 2'-O-methyl-adenosine
  modified_base 11: mod_base = cm
  modified_base 12: mod_base = cm
  modified_base 13: mod_base = um
  modified_base 14: mod_base = OTHER; note = 2'-Fluoro-cytidine
  modified_base 15: mod_base = um
  modified_base 16: mod_base = OTHER; note = 2'-Fluoro-guanosine
  modified_base 17: mod_base = OTHER; note = 2'-O-methyl-adenosine
  modified_base 18: mod_base = gm
  modified_base 19: mod_base = gm
  modified_base 20: mod_base = OTHER; note = 2'-O-methyl-adenosine
  modified_base 21: mod_base = um
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = gm
ttcggtcaaacctctgaggattg

SEQ ID NO: 484 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = gm
  modified_base 4: mod_base = um
  modified_base 5: mod_base = cm
  modified_base 6: mod_base = OTHER; note = 2'-Fluoro-cytidine
  modified_base 7: mod_base = cm
  modified_base 8: mod_base = OTHER; note = 2'-Fluoro-guanosine
  modified_base 9: mod_base = OTHER; note = 2'-Fluoro-adenosine
  modified_base 10: mod_base = um
  modified_base 11: mod_base = gm
  modified_base 12: mod_base = um
  modified_base 13: mod_base = cm
  modified_base 14: mod_base = OTHER; note = 2'-Fluoro-cytidine
  modified_base 15: mod_base = OTHER; note = 2'-O-methyl-adenosine
  modified_base 16: mod_base = OTHER; note = 2'-Fluoro-cytidine
  modified_base 17: mod_base = um
  modified_base 18: mod_base = gm
  modified_base 19: mod_base = um
  modified_base 20: mod_base = gm
  modified_base 21: mod_base = OTHER; note = 2'-O-methyl-adenosine
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = um
gtgtcccgatgtccactgtgatt

SEQ ID NO: 485 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = cm
  modified_base 4: mod_base = um
  modified_base 5: mod_base = um
  modified_base 6: mod_base = OTHER; note = 2'-Fluoro-cytidine
  modified_base 7: mod_base = OTHER; note = 2'-O-methyl-adenosine
  modified_base 8: mod_base = OTHER; note = 2'-Fluoro-adenosine
  modified_base 9: mod_base = OTHER; note = 2'-Fluoro-guanosine
  modified_base 10: mod_base = gm
  modified_base 11: mod_base = cm
  modified_base 12: mod_base = um
  modified_base 13: mod_base = um
  modified_base 14: mod_base = OTHER; note = 2'-Fluoro-cytidine
  modified_base 15: mod_base = um
  modified_base 16: mod_base = OTHER; note = 2'-Fluoro-uridine
  modified_base 17: mod_base = gm
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = cm
tccttcaaggcttcttgaaagcc

SEQ ID NO: 486 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = um
  modified_base 6: mod_base = OTHER; note = 2'-Fluoro-uridine
  modified_base 7: mod_base = OTHER; note = 2'-O-methyl-adenosine
  modified_base 8: mod_base = OTHER; note = 2'-Fluoro-guanosine
  modified_base 9: mod_base = OTHER; note = 2'-Fluoro-adenosine
  modified_base 10: mod_base = gm
  modified_base 11: mod_base = cm
  modified_base 12: mod_base = OTHER; note = 2'-O-methyl-adenosine
  modified_base 13: mod_base = gm
  modified_base 14: mod_base = OTHER; note = 2'-Fluoro-adenosine
  modified_base 15: mod_base = gm
  modified_base 16: mod_base = OTHER; note = 2'-Fluoro-adenosine
  modified_base 17: mod_base = cm
  modified_base 18: mod_base = OTHER; note = 2'-O-methyl-adenosine
  modified_base 19: mod_base = cm
  modified_base 20: mod_base = cm
  modified_base 21: mod_base = um
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = cm
ttacttagagcagagacacctcc

SEQ ID NO: 487 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = OTHER; note = 2'-O-methyl-adenosine
  modified_base 4: mod_base = gm
  modified_base 5: mod_base = cm
  modified_base 6: mod_base = OTHER; note = 2'-Fluoro-adenosine
  modified_base 7: mod_base = gm
  modified_base 8: mod_base = OTHER; note = 2'-Fluoro-adenosine
  modified_base 9: mod_base = OTHER; note = 2'-Fluoro-guanosine
  modified_base 10: mod_base = OTHER; note = 2'-O-methyl-adenosine
  modified_base 11: mod_base = cm
  modified_base 12: mod_base = OTHER; note = 2'-O-methyl-adenosine
  modified_base 13: mod_base = cm
  modified_base 14: mod_base = OTHER; note = 2'-Fluoro-cytidine
  modified_base 15: mod_base = um
  modified_base 16: mod_base = OTHER; note = 2'-Fluoro-cytidine
  modified_base 17: mod_base = cm
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = OTHER; note = 2'-O-methyl-adenosine
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = OTHER; note = 2'-O-methyl-adenosine
agagcagagacacctccaaaata

SEQ ID NO: 488 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = um
  modified_base 4: mod_base = um
  modified_base 5: mod_base = OTHER; note = 2'-O-methyl-adenosine
  modified_base 6: mod_base = OTHER; note = 2'-Fluoro-adenosine
  modified_base 7: mod_base = OTHER; note = 2'-O-methyl-adenosine
  modified_base 8: mod_base = OTHER; note = 2'-Fluoro-adenosine
  modified_base 9: mod_base = OTHER; note = 2'-Fluoro-guanosine
  modified_base 10: mod_base = gm
  modified_base 11: mod_base = cm
  modified_base 12: mod_base = OTHER; note = 2'-O-methyl-adenosine
  modified_base 13: mod_base = cm
  modified_base 14: mod_base = OTHER; note = 2'-Fluoro-adenosine
  modified_base 15: mod_base = um
  modified_base 16: mod_base = OTHER; note = 2'-Fluoro-uridine
  modified_base 17: mod_base = cm
  modified_base 18: mod_base = OTHER; note = 2'-O-methyl-adenosine
  modified_base 19: mod_base = um
  modified_base 20: mod_base = gm
  modified_base 21: mod_base = cm
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = gm
aattaaaaggcacattcatgctg

SEQ ID NO: 489 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = um
  modified_base 4: mod_base = OTHER; note = 2'-O-methyl-adenosine
  modified_base 5: mod_base = gm
  modified_base 6: mod_base = OTHER; note = 2'-Fluoro-cytidine
  modified_base 7: mod_base = um
  modified_base 8: mod_base = OTHER; note = 2'-Fluoro-cytidine
  modified_base 9: mod_base = OTHER; note = 2'-Fluoro-guanosine
  modified_base 10: mod_base = gm
  modified_base 11: mod_base = um
  modified_base 12: mod_base = gm
  modified_base 13: mod_base = um
  modified_base 14: mod_base = OTHER; note = 2'-Fluoro-cytidine
  modified_base 15: mod_base = cm
  modified_base 16: mod_base = OTHER; note = 2'-Fluoro-cytidine
  modified_base 17: mod_base = gm
  modified_base 18: mod_base = OTHER; note = 2'-O-methyl-adenosine
  modified_base 19: mod_base = um
  modified_base 20: mod_base = gm
  modified_base 21: mod_base = um
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = cm
gctagctcggtgtcccgatgtcc

SEQ ID NO: 490 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = um
  modified_base 4: mod_base = um
  modified_base 5: mod_base = gm
  modified_base 6: mod_base = OTHER; note = 2'-Fluoro-uridine
  modified_base 7: mod_base = gm
  modified_base 8: mod_base = OTHER; note = 2'-Fluoro-adenosine
  modified_base 9: mod_base = OTHER; note = 2'-Fluoro-guanosine
  modified_base 10: mod_base = gm
  modified_base 11: mod_base = OTHER; note = 2'-O-methyl-adenosine
  modified_base 12: mod_base = gm
  modified_base 13: mod_base = OTHER; note = 2'-O-methyl-adenosine
  modified_base 14: mod_base = OTHER; note = 2'-Fluoro-guanosine
  modified_base 15: mod_base = OTHER; note = 2'-O-methyl-adenosine
  modified_base 16: mod_base = OTHER; note = 2'-Fluoro-cytidine
  modified_base 17: mod_base = gm
  modified_base 18: mod_base = cm
  modified_base 19: mod_base = OTHER; note = 2'-O-methyl-adenosine
  modified_base 20: mod_base = gm
  modified_base 21: mod_base = um
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = cm
ccttgtgaggagagacgcagtcc

SEQ ID NO: 491 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = cm
  modified_base 4: mod_base = OTHER; note = 2'-O-methyl-adenosine
  modified_base 5: mod_base = cm
  modified_base 6: mod_base = OTHER; note = 2'-Fluoro-uridine
  modified_base 7: mod_base = gm
  modified_base 8: mod_base = OTHER; note = 2'-Fluoro-uridine
  modified_base 9: mod_base = OTHER; note = 2'-Fluoro-guanosine
  modified_base 10: mod_base = OTHER; note = 2'-O-methyl-adenosine
  modified_base 11: mod_base = um
  modified_base 12: mod_base = um
  modified_base 13: mod_base = um
  modified_base 14: mod_base = OTHER; note = 2'-Fluoro-guanosine
  modified_base 15: mod_base = gm
  modified_base 16: mod_base = OTHER; note = 2'-Fluoro-guanosine
  modified_base 17: mod_base = um
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = cm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = OTHER; note = 2'-O-methyl-adenosine
tccactgtgatttgggtatacaa

SEQ ID NO: 492 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = um
  modified_base 4: mod_base = OTHER; note = 2'-O-methyl-adenosine
  modified_base 5: mod_base = um
  modified_base 6: mod_base = OTHER; note = 2'-Fluoro-cytidine
  modified_base 7: mod_base = um
  modified_base 8: mod_base = OTHER; note = 2'-Fluoro-cytidine
  modified_base 9: mod_base = OTHER; note = 2'-Fluoro-uridine
  modified_base 10: mod_base = gm
  modified_base 11: mod_base = um
  modified_base 12: mod_base = OTHER; note = 2'-O-methyl-adenosine
  modified_base 13: mod_base = cm
  modified_base 14: mod_base = OTHER; note = 2'-Fluoro-adenosine
  modified_base 15: mod_base = um
  modified_base 16: mod_base = OTHER; note = 2'-Fluoro-cytidine
  modified_base 17: mod_base = cm
  modified_base 18: mod_base = OTHER; note = 2'-O-methyl-adenosine
  modified_base 19: mod_base = gm
  modified_base 20: mod_base = cm
  modified_base 21: mod_base = OTHER; note = 2'-O-methyl-adenosine
  modified_base 21^22: mod_base = OTHER; note = Phosphorothioate bond
  modified_base 22: mod_base = cm
  modified_base 22^23: mod_base = OTHER; note = Phosphorothioate bond
  modified_base 23: mod_base = cm
ggtatctctgtacatccagcacc

SEQ ID NO: 493 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = gm
  modified_base 5: mod_base = gm
  modified_base 6: mod_base = OTHER; note = 2'-Fluoro-adenosine
  modified_base 7: mod_base = OTHER; note = 2'-O-methyl-adenosine
  modified_base 8: mod_base = OTHER; note = 2'-Fluoro-adenosine
  modified_base 9: mod_base = OTHER; note = 2'-Fluoro-uridine
  modified_base 10: mod_base = um
  modified_base 11: mod_base = cm
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-Fluoro-guanosine
  modified_base 15: mod_base = um
  modified_base 16: mod_base = OTHER; note = 2'-Fluoro-uridine
  modified_base 17: mod_base = um
  modified_base 18: mod_base = OTHER; note = 2'-O-methyl-adenosine
  modified_base 19: mod_base = cm
  modified_base 20: mod_base = OTHER; note = 2'-O-methyl-adenosine
  modified_base 21: mod_base = um
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = gm
ataggaaattcaagtttacatag

SEQ ID NO: 494 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = um
  modified_base 4: mod_base = cm
  modified_base 5: mod_base = um
  modified_base 6: mod_base = OTHER; note = 2'-Fluoro-uridine
  modified_base 7: mod_base = cm
  modified_base 8: mod_base = OTHER; note = 2'-Fluoro-uridine
  modified_base 9: mod_base = OTHER; note = 2'-Fluoro-cytidine
  modified_base 10: mod_base = cm
  modified_base 11: mod_base = um
  modified_base 12: mod_base = cm
  modified_base 13: mod_base = cm
  modified_base 14: mod_base = OTHER; note = 2'-Fluoro-cytidine
  modified_base 15: mod_base = cm
  modified_base 16: mod_base = OTHER; note = 2'-Fluoro-adenosine
  modified_base 17: mod_base = gm
  modified_base 18: mod_base = cm
  modified_base 19: mod_base = cm
  modified_base 20: mod_base = cm
  modified_base 21: mod_base = cm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = OTHER; note = 2'-O-methyl-adenosine
catcttctcctccccagccccaa

SEQ ID NO: 495 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = um
  modified_base 4: mod_base = um
  modified_base 5: mod_base = gm
  modified_base 6: mod_base = OTHER; note = 2'-Fluoro-uridine
  modified_base 7: mod_base = um
  modified_base 8: mod_base = OTHER; note = 2'-Fluoro-uridine
  modified_base 9: mod_base = OTHER; note = 2'-Fluoro-adenosine
  modified_base 10: mod_base = cm
  modified_base 11: mod_base = um
  modified_base 12: mod_base = um
  modified_base 13: mod_base = OTHER; note = 2'-O-methyl-adenosine
  modified_base 14: mod_base = OTHER; note = 2'-Fluoro-guanosine
  modified_base 15: mod_base = OTHER; note = 2'-O-methyl-adenosine
  modified_base 16: mod_base = OTHER; note = 2'-Fluoro-guanosine
  modified_base 17: mod_base = cm
  modified_base 18: mod_base = OTHER; note = 2'-O-methyl-adenosine
  modified_base 19: mod_base = gm
  modified_base 20: mod_base = OTHER; note = 2'-O-methyl-adenosine
  modified_base 21: mod_base = gm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = cm
tgttgtttacttagagcagagac

SEQ ID NO: 496 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = cm
  modified_base 4: mod_base = um
  modified_base 5: mod_base = um
  modified_base 6: mod_base = OTHER; note = 2'-Fluoro-cytidine
  modified_base 7: mod_base = um
  modified_base 8: mod_base = OTHER; note = 2'-Fluoro-cytidine
  modified_base 9: mod_base = OTHER; note = 2'-Fluoro-cytidine
  modified_base 10: mod_base = um
  modified_base 11: mod_base = cm
  modified_base 12: mod_base = cm
  modified_base 13: mod_base = cm
  modified_base 14: mod_base = OTHER; note = 2'-Fluoro-cytidine
  modified_base 15: mod_base = OTHER; note = 2'-O-methyl-adenosine
  modified_base 16: mod_base = OTHER; note = 2'-Fluoro-guanosine
  modified_base 17: mod_base = cm
  modified_base 18: mod_base = cm
  modified_base 19: mod_base = cm
  modified_base 20: mod_base = cm
  modified_base 21: mod_base = OTHER; note = 2'-O-methyl-adenosine
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = um
atcttctcctccccagccccaat

SEQ ID NO: 497 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = cm
  modified_base 4: mod_base = cm
  modified_base 5: mod_base = cm
  modified_base 6: mod_base = OTHER; note = 2'-Fluoro-guanosine
  modified_base 7: mod_base = OTHER; note = 2'-O-methyl-adenosine
  modified_base 8: mod_base = OTHER; note = 2'-Fluoro-uridine
  modified_base 9: mod_base = OTHER; note = 2'-Fluoro-guanosine
  modified_base 10: mod_base = um
  modified_base 11: mod_base = cm
  modified_base 12: mod_base = cm
  modified_base 13: mod_base = OTHER; note = 2'-O-methyl-adenosine
  modified_base 14: mod_base = OTHER; note = 2'-Fluoro-cytidine
  modified_base 15: mod_base = um
  modified_base 16: mod_base = OTHER; note = 2'-Fluoro-guanosine
  modified_base 17: mod_base = um
  modified_base 18: mod_base = gm
  modified_base 19: mod_base = OTHER; note = 2'-O-methyl-adenosine
  modified_base 20: mod_base = um
  modified_base 21: mod_base = um
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = gm
gtcccgatgtccactgtgatttg

SEQ ID NO: 498 - RNA, 23 nt, synthetic construct
  source 1..23: mol_type = other RNA
  modified_base 1: mod_base = cm
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = cm
  modified_base 4: mod_base = gm
  modified_base 5: mod_base = gm
  modified_base 6: mod_base = OTHER; note = 2'-Fluoro-uridine
  modified_base 7: mod_base = gm
  modified_base 8: mod_base = OTHER; note = 2'-Fluoro-uridine
  modified_base 9: mod_base = OTHER; note = 2'-Fluoro-cytidine
  modified_base 10: mod_base = cm
  modified_base 11: mod_base = cm
  modified_base 12: mod_base = gm
  modified_base 13: mod_base = OTHER; note = 2'-O-methyl-adenosine
  modified_base 14: mod_base = OTHER; note = 2'-Fluoro-uridine
  modified_base 15: mod_base = gm
  modified_base 16: mod_base = OTHER; note = 2'-Fluoro-uridine
  modified_base 17: mod_base = cm
  modified_base 18: mod_base = cm
  modified_base 19: mod_base = OTHER; note = 2'-O-methyl-adenosine
  modified_base 20: mod_base = cm
  modified_base 21: mod_base = um
  modified_base 21^22: mod_base = OTHER; note = Phosphorothioate bond
  modified_base 22: mod_base = gm
  modified_base 22^23: mod_base = OTHER; note = Phosphorothioate bond
  modified_base 23: mod_base = um
ctcggtgtcccgatgtccactgt

SEQ ID NO: 499 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-cytidine
  modified_base 2^3: mod_base = OTHER; note = Phosphorothioate bond
  modified_base 3: mod_base = cm
  modified_base 4: mod_base = cm
  modified_base 5: mod_base = cm
  modified_base 6: mod_base = OTHER; note = 2'-Fluoro-adenosine
  modified_base 7: mod_base = gm
  modified_base 8: mod_base = OTHER; note = 2'-Fluoro-cytidine
  modified_base 9: mod_base = OTHER; note = 2'-Fluoro-cytidine
  modified_base 10: mod_base = cm
  modified_base 11: mod_base = cm
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-Fluoro-uridine
  modified_base 15: mod_base = OTHER; note = 2'-O-methyl-adenosine
  modified_base 16: mod_base = OTHER; note = 2'-Fluoro-adenosine
  modified_base 17: mod_base = um
  modified_base 18: mod_base = um
  modified_base 19: mod_base = OTHER; note = 2'-O-methyl-adenosine
  modified_base 20: mod_base = um
  modified_base 21: mod_base = um
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = gm
tccccagccccaataattattag

SEQ ID NO: 500 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = OTHER; note = 2'-O-methyl-adenosine
  modified_base 4: mod_base = gm
  modified_base 5: mod_base = OTHER; note = 2'-O-methyl-adenosine
  modified_base 6: mod_base = OTHER; note = 2'-Fluoro-cytidine
  modified_base 7: mod_base = OTHER; note = 2'-O-methyl-adenosine
  modified_base 8: mod_base = OTHER; note = 2'-Fluoro-cytidine
  modified_base 9: mod_base = OTHER; note = 2'-Fluoro-cytidine
  modified_base 10: mod_base = um
  modified_base 11: mod_base = cm
  modified_base 12: mod_base = cm
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-adenosine
  modified_base 17: mod_base = um
  modified_base 18: mod_base = OTHER; note = 2'-O-methyl-adenosine
  modified_base 19: mod_base = cm
  modified_base 20: mod_base = um
  modified_base 21: mod_base = gm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = OTHER; note = 2'-O-methyl-adenosine
agagacacctccaaaatactgaa

SEQ ID NO: 501 - RNA, 23 nt, synthetic construct
  source 1..23: mol_type = other RNA
  modified_base 1: mod_base = gm
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = gm
  modified_base 4: mod_base = cm
  modified_base 5: mod_base = OTHER; note = 2'-O-methyl-adenosine
  modified_base 6: mod_base = OTHER; note = 2'-Fluoro-guanosine
  modified_base 7: mod_base = OTHER; note = 2'-O-methyl-adenosine
  modified_base 8: mod_base = OTHER; note = 2'-Fluoro-guanosine
  modified_base 9: mod_base = OTHER; note = 2'-Fluoro-adenosine
  modified_base 10: mod_base = cm
  modified_base 11: mod_base = OTHER; note = 2'-O-methyl-adenosine
  modified_base 12: mod_base = cm
  modified_base 13: mod_base = cm
  modified_base 14: mod_base = OTHER; note = 2'-Fluoro-uridine
  modified_base 15: mod_base = cm
  modified_base 16: mod_base = OTHER; note = 2'-Fluoro-cytidine
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = um
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = cm
gagcagagacacctccaaaatac

SEQ ID NO: 502 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-Fluoro-cytidine
  modified_base 5: mod_base = OTHER; note = 2'-O-methyl-adenosine
  modified_base 6: mod_base = OTHER; note = 2'-Fluoro-uridine
  modified_base 7: mod_base = OTHER; note = 2'-O-methyl-adenosine
  modified_base 8: mod_base = gm
  modified_base 9: mod_base = gm
  modified_base 10: mod_base = OTHER; note = 2'-O-methyl-adenosine
  modified_base 11: mod_base = OTHER; note = 2'-O-methyl-adenosine
  modified_base 12: mod_base = OTHER; note = 2'-O-methyl-adenosine
  modified_base 13: mod_base = um
  modified_base 14: mod_base = OTHER; note = 2'-Fluoro-uridine
  modified_base 15: mod_base = cm
  modified_base 16: mod_base = OTHER; note = 2'-Fluoro-adenosine
  modified_base 17: mod_base = OTHER; note = 2'-O-methyl-adenosine
  modified_base 18: mod_base = gm
  modified_base 19: mod_base = um
  modified_base 20: mod_base = um
  modified_base 21: mod_base = um
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = cm
atacataggaaattcaagtttac

SEQ ID NO: 503 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = OTHER; note = 2'-O-methyl-adenosine
  modified_base 6: mod_base = OTHER; note = 2'-Fluoro-uridine
  modified_base 7: mod_base = OTHER; note = 2'-O-methyl-adenosine
  modified_base 8: mod_base = gm
  modified_base 9: mod_base = OTHER; note = 2'-Fluoro-guanosine
  modified_base 10: mod_base = OTHER; note = 2'-O-methyl-adenosine
  modified_base 11: mod_base = OTHER; note = 2'-O-methyl-adenosine
  modified_base 12: mod_base = OTHER; note = 2'-O-methyl-adenosine
  modified_base 13: mod_base = um
  modified_base 14: mod_base = OTHER; note = 2'-Fluoro-uridine
  modified_base 15: mod_base = cm
  modified_base 16: mod_base = OTHER; note = 2'-Fluoro-adenosine
  modified_base 17: mod_base = OTHER; note = 2'-O-methyl-adenosine
  modified_base 18: mod_base = gm
  modified_base 19: mod_base = um
  modified_base 20: mod_base = um
  modified_base 21: mod_base = um
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = cm
atacataggaaattcaagtttac

SEQ ID NO: 504 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-Fluoro-adenosine
  modified_base 5: mod_base = um
  modified_base 6: mod_base = OTHER; note = 2'-Fluoro-adenosine
  modified_base 7: mod_base = cm
  modified_base 8: mod_base = OTHER; note = 2'-O-methyl-adenosine
  modified_base 9: mod_base = um
  modified_base 10: mod_base = OTHER; note = 2'-O-methyl-adenosine
  modified_base 11: mod_base = gm
  modified_base 12: mod_base = gm
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-uridine
  modified_base 17: mod_base = um
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = um
aaaatacataggaaattcaagtt

SEQ ID NO: 505 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-O-methyl-adenosine
  modified_base 5: mod_base = um
  modified_base 6: mod_base = OTHER; note = 2'-Fluoro-adenosine
  modified_base 7: mod_base = cm
  modified_base 8: mod_base = OTHER; note = 2'-O-methyl-adenosine
  modified_base 9: mod_base = OTHER; note = 2'-Fluoro-uridine
  modified_base 10: mod_base = OTHER; note = 2'-O-methyl-adenosine
  modified_base 11: mod_base = gm
  modified_base 12: mod_base = gm
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-uridine
  modified_base 17: mod_base = um
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = um
aaaatacataggaaattcaagtt

SEQ ID NO: 506 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = OTHER; note = 2'-Fluoro-uridine
  modified_base 5: mod_base = OTHER; note = 2'-O-methyl-adenosine
  modified_base 6: mod_base = OTHER; note = 2'-Fluoro-adenosine
  modified_base 7: mod_base = gm
  modified_base 8: mod_base = gm
  modified_base 9: mod_base = cm
  modified_base 10: mod_base = OTHER; note = 2'-O-methyl-adenosine
  modified_base 11: mod_base = cm
  modified_base 12: mod_base = um
  modified_base 13: mod_base = um
  modified_base 14: mod_base = OTHER; note = 2'-Fluoro-uridine
  modified_base 15: mod_base = gm
  modified_base 16: mod_base = OTHER; note = 2'-Fluoro-guanosine
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = cm
ttttaaggcactttggaaaagtc

SEQ ID NO: 507 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = um
  modified_base 5: mod_base = OTHER; note = 2'-O-methyl-adenosine
  modified_base 6: mod_base = OTHER; note = 2'-Fluoro-adenosine
  modified_base 7: mod_base = gm
  modified_base 8: mod_base = gm
  modified_base 9: mod_base = OTHER; note = 2'-Fluoro-cytidine
  modified_base 10: mod_base = OTHER; note = 2'-O-methyl-adenosine
  modified_base 11: mod_base = cm
  modified_base 12: mod_base = um
  modified_base 13: mod_base = um
  modified_base 14: mod_base = OTHER; note = 2'-Fluoro-uridine
  modified_base 15: mod_base = gm
  modified_base 16: mod_base = OTHER; note = 2'-Fluoro-guanosine
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = cm
ttttaaggcactttggaaaagtc

SEQ ID NO: 508 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-Fluoro-guanosine
  modified_base 5: mod_base = OTHER; note = 2'-O-methyl-adenosine
  modified_base 6: mod_base = OTHER; note = 2'-Fluoro-cytidine
  modified_base 7: mod_base = OTHER; note = 2'-O-methyl-adenosine
  modified_base 8: mod_base = cm
  modified_base 9: mod_base = cm
  modified_base 10: mod_base = um
  modified_base 11: mod_base = cm
  modified_base 12: mod_base = cm
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-adenosine
  modified_base 17: mod_base = um
  modified_base 18: mod_base = OTHER; note = 2'-O-methyl-adenosine
  modified_base 19: mod_base = cm
  modified_base 20: mod_base = um
  modified_base 21: mod_base = gm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = OTHER; note = 2'-O-methyl-adenosine
agagacacctccaaaatactgaa

SEQ ID NO: 509 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = OTHER; note = 2'-O-methyl-adenosine
  modified_base 4: mod_base = gm
  modified_base 5: mod_base = OTHER; note = 2'-O-methyl-adenosine
  modified_base 6: mod_base = OTHER; note = 2'-Fluoro-cytidine
  modified_base 7: mod_base = OTHER; note = 2'-O-methyl-adenosine
  modified_base 8: mod_base = cm
  modified_base 9: mod_base = OTHER; note = 2'-Fluoro-cytidine
  modified_base 10: mod_base = um
  modified_base 11: mod_base = cm
  modified_base 12: mod_base = cm
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-adenosine
  modified_base 17: mod_base = um
  modified_base 18: mod_base = OTHER; note = 2'-O-methyl-adenosine
  modified_base 19: mod_base = cm
  modified_base 20: mod_base = um
  modified_base 21: mod_base = gm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = OTHER; note = 2'-O-methyl-adenosine
agagacacctccaaaatactgaa

SEQ ID NO: 510 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = OTHER; note = 2'-O-methyl-adenosine
  modified_base 6: mod_base = OTHER; note = 2'-Fluoro-uridine
  modified_base 7: mod_base = OTHER; note = 2'-O-methyl-adenosine
  modified_base 8: mod_base = gm
  modified_base 9: mod_base = gm
  modified_base 10: mod_base = OTHER; note = 2'-O-methyl-adenosine
  modified_base 11: mod_base = OTHER; note = 2'-O-methyl-adenosine
  modified_base 12: mod_base = OTHER; note = 2'-O-methyl-adenosine
  modified_base 13: mod_base = um
  modified_base 14: mod_base = OTHER; note = 2'-Fluoro-uridine
  modified_base 15: mod_base = cm
  modified_base 16: mod_base = OTHER; note = 2'-Fluoro-adenosine
  modified_base 17: mod_base = OTHER; note = 2'-O-methyl-adenosine
  modified_base 18: mod_base = OTHER; note = 2'-Fluoro-guanosine
  modified_base 19: mod_base = um
  modified_base 20: mod_base = um
  modified_base 21: mod_base = um
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = cm
atacataggaaattcaagtttac

SEQ ID NO: 511 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-adenosine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-O-methyl-adenosine
  modified_base 5: mod_base = um
  modified_base 6: mod_base = OTHER; note = 2'-Fluoro-adenosine
  modified_base 7: mod_base = cm
  modified_base 8: mod_base = OTHER; note = 2'-O-methyl-adenosine
  modified_base 9: mod_base = um
  modified_base 10: mod_base = OTHER; note = 2'-O-methyl-adenosine
  modified_base 11: mod_base = gm
  modified_base 12: mod_base = gm
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-uridine
  modified_base 17: mod_base = um
  modified_base 18: mod_base = OTHER; note = 2'-Fluoro-cytidine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = um
aaaatacataggaaattcaagtt

SEQ ID NO: 512 - RNA, 23 nt, synthetic construct
  source 1..23: mol_type = other RNA
  modified_base 1: mod_base = um
  modified_base 1^2: mod_base = OTHER; note = Phosphorothioate bond
  modified_base 2: mod_base = OTHER; note = 2'-Fluoro-uridine
  modified_base 2^3: mod_base = OTHER; note = Phosphorothioate bond
  modified_base 3: mod_base = um
  modified_base 4: mod_base = um
  modified_base 5: mod_base = OTHER; note = 2'-O-methyl-adenosine
  modified_base 6: mod_base = OTHER; note = 2'-Fluoro-adenosine
  modified_base 7: mod_base = gm
  modified_base 8: mod_base = gm
  modified_base 9: mod_base = cm
  modified_base 10: mod_base = OTHER; note = 2'-O-methyl-adenosine
  modified_base 11: mod_base = cm
  modified_base 12: mod_base = um
  modified_base 13: mod_base = um
  modified_base 14: mod_base = OTHER; note = 2'-Fluoro-uridine
  modified_base 15: mod_base = gm
  modified_base 16: mod_base = OTHER; note = 2'-Fluoro-guanosine
  modified_base 17: mod_base = OTHER; note = 2'-O-methyl-adenosine
  modified_base 18: mod_base = OTHER; note = 2'-Fluoro-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
  modified_base 21^22: mod_base = OTHER; note = Phosphorothioate bond
  modified_base 22: mod_base = um
  modified_base 22^23: mod_base = OTHER; note = Phosphorothioate bond
  modified_base 23: mod_base = cm
ttttaaggcactttggaaaagtc

SEQ ID NO: 513 - RNA, 23 nt, synthetic construct
  source 1..23: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-Fluoro-guanosine
  modified_base 2^3: mod_base = OTHER; note = Phosphorothioate bond
  modified_base 3: mod_base = OTHER; note = 2'-O-methyl-adenosine
  modified_base 4: mod_base = gm
  modified_base 5: mod_base = OTHER; note = 2'-O-methyl-adenosine
  modified_base 6: mod_base = OTHER; note = 2'-Fluoro-cytidine
  modified_base 7: mod_base = OTHER; note = 2'-O-methyl-adenosine
  modified_base 8: mod_base = cm
  modified_base 9: mod_base = cm
  modified_base 10: mod_base = um
  modified_base 11: mod_base = cm
  modified_base 12: mod_base = cm
  modified_base 13: mod_base = OTHER; note = 2'-O-methyl-adenosine
  modified_base 14: mod_base = OTHER; note = 2'-Fluoro-adenosine
  modified_base 15: mod_base = OTHER; note = 2'-O-methyl-adenosine
  modified_base 16: mod_base = OTHER; note = 2'-Fluoro-adenosine
  modified_base 17: mod_base = um
  modified_base 18: mod_base = OTHER; note = 2'-Fluoro-adenosine
  modified_base 19: mod_base = cm
  modified_base 20: mod_base = um
  modified_base 21: mod_base = gm
  modified_base 21^22: mod_base = OTHER; note = Phosphorothioate bond
  modified_base 22: mod_base = OTHER; note = 2'-O-methyl-adenosine
  modified_base 22^23: mod_base = OTHER; note = Phosphorothioate bond
  modified_base 23: mod_base = OTHER; note = 2'-O-methyl-adenosine
agagacacctccaaaatactgaa

SEQ ID NO: 514 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = gm
  modified_base 5: mod_base = OTHER; note = 2'-O-methyl-adenosine
  modified_base 6: mod_base = OTHER; note = 2'-O-methyl-adenosine
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = OTHER; note = 2'-Fluoro-cytidine
  modified_base 11: mod_base = OTHER; note = 2'-Fluoro-cytidine
  modified_base 12: mod_base = um
  modified_base 13: mod_base = OTHER; note = 2'-O-methyl-adenosine
  modified_base 14: mod_base = um
  modified_base 15: mod_base = gm
  modified_base 16: mod_base = um
  modified_base 17: mod_base = OTHER; note = 2'-O-methyl-adenosine
  modified_base 18: mod_base = um
  modified_base 19: mod_base = um
  modified_base 20: mod_base = um
  modified_base 21: mod_base = um
cttgaatttcctatgtatttt

SEQ ID NO: 515 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = gm
  modified_base 4: mod_base = cm
  modified_base 5: mod_base = um
  modified_base 6: mod_base = gm
  modified_base 7: mod_base = OTHER; note = 2'-Fluoro-guanosine
  modified_base 8: mod_base = OTHER; note = 2'-O-methyl-adenosine
  modified_base 9: mod_base = OTHER; note = 2'-Fluoro-uridine
  modified_base 10: mod_base = OTHER; note = 2'-Fluoro-guanosine
  modified_base 11: mod_base = OTHER; note = 2'-Fluoro-uridine
  modified_base 12: mod_base = OTHER; note = 2'-O-methyl-adenosine
  modified_base 13: mod_base = cm
  modified_base 14: mod_base = OTHER; note = 2'-O-methyl-adenosine
  modified_base 15: mod_base = gm
  modified_base 16: mod_base = OTHER; note = 2'-O-methyl-adenosine
  modified_base 17: mod_base = gm
  modified_base 18: mod_base = OTHER; note = 2'-O-methyl-adenosine
  modified_base 19: mod_base = um
  modified_base 20: mod_base = OTHER; note = 2'-O-methyl-adenosine
  modified_base 21: mod_base = cm
gtgctggatgtacagagatac

SEQ ID NO: 516 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = cm
  modified_base 4: mod_base = cm
  modified_base 5: mod_base = OTHER; note = 2'-O-methyl-adenosine
  modified_base 6: mod_base = OTHER; note = 2'-O-methyl-adenosine
  modified_base 7: mod_base = OTHER; note = 2'-Fluoro-adenosine
  modified_base 8: mod_base = gm
  modified_base 9: mod_base = OTHER; note = 2'-Fluoro-uridine
  modified_base 10: mod_base = OTHER; note = 2'-Fluoro-guanosine
  modified_base 11: mod_base = OTHER; note = 2'-Fluoro-cytidine
  modified_base 12: mod_base = cm
  modified_base 13: mod_base = um
  modified_base 14: mod_base = um
  modified_base 15: mod_base = OTHER; note = 2'-O-methyl-adenosine
  modified_base 16: mod_base = OTHER; note = 2'-O-methyl-adenosine
  modified_base 17: mod_base = OTHER; note = 2'-O-methyl-adenosine
  modified_base 18: mod_base = OTHER; note = 2'-O-methyl-adenosine
  modified_base 19: mod_base = gm
  modified_base 20: mod_base = OTHER; note = 2'-O-methyl-adenosine
  modified_base 21: mod_base = OTHER; note = 2'-O-methyl-adenosine
ttccaaagtgccttaaaagaa

SEQ ID NO: 517 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = um
  modified_base 4: mod_base = OTHER; note = 2'-O-methyl-adenosine
  modified_base 5: mod_base = um
  modified_base 6: mod_base = gm
  modified_base 7: mod_base = OTHER; note = 2'-Fluoro-uridine
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-adenosine
  modified_base 11: mod_base = OTHER; note = 2'-Fluoro-cytidine
  modified_base 12: mod_base = um
  modified_base 13: mod_base = um
  modified_base 14: mod_base = gm
  modified_base 15: mod_base = OTHER; note = 2'-O-methyl-adenosine
  modified_base 16: mod_base = OTHER; note = 2'-O-methyl-adenosine
  modified_base 17: mod_base = um
  modified_base 18: mod_base = um
  modified_base 19: mod_base = um
  modified_base 20: mod_base = cm
  modified_base 21: mod_base = cm
gctatgtaaacttgaatttcc

SEQ ID NO: 518 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = gm
  modified_base 4: mod_base = gm
  modified_base 5: mod_base = cm
  modified_base 6: mod_base = OTHER; note = 2'-O-methyl-adenosine
  modified_base 7: mod_base = OTHER; note = 2'-Fluoro-cytidine
  modified_base 8: mod_base = OTHER; note = 2'-O-methyl-adenosine
  modified_base 9: mod_base = OTHER; note = 2'-Fluoro-uridine
  modified_base 10: mod_base = OTHER; note = 2'-Fluoro-uridine
  modified_base 11: mod_base = OTHER; note = 2'-Fluoro-uridine
  modified_base 12: mod_base = cm
  modified_base 13: mod_base = cm
  modified_base 14: mod_base = gm
  modified_base 15: mod_base = um
  modified_base 16: mod_base = um
  modified_base 17: mod_base = gm
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = um
acggcacatttccgttgcaat

SEQ ID NO: 519 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = gm
  modified_base 6: mod_base = um
  modified_base 7: mod_base = OTHER; note = 2'-Fluoro-adenosine
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-cytidine
  modified_base 11: mod_base = OTHER; note = 2'-Fluoro-uridine
  modified_base 12: mod_base = um
  modified_base 13: mod_base = gm
  modified_base 14: mod_base = OTHER; note = 2'-O-methyl-adenosine
  modified_base 15: mod_base = OTHER; note = 2'-O-methyl-adenosine
  modified_base 16: mod_base = um
  modified_base 17: mod_base = um
  modified_base 18: mod_base = um
  modified_base 19: mod_base = cm
  modified_base 20: mod_base = cm
  modified_base 21: mod_base = um
ctatgtaaacttgaatttcct

SEQ ID NO: 520 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = gm
  modified_base 6: mod_base = gm
  modified_base 7: mod_base = OTHER; note = 2'-Fluoro-adenosine
  modified_base 8: mod_base = um
  modified_base 9: mod_base = OTHER; note = 2'-Fluoro-uridine
  modified_base 10: mod_base = OTHER; note = 2'-Fluoro-uridine
  modified_base 11: mod_base = OTHER; note = 2'-Fluoro-cytidine
  modified_base 12: mod_base = cm
  modified_base 13: mod_base = um
  modified_base 14: mod_base = OTHER; note = 2'-O-methyl-adenosine
  modified_base 15: mod_base = OTHER; note = 2'-O-methyl-adenosine
  modified_base 16: mod_base = um
  modified_base 17: mod_base = OTHER; note = 2'-O-methyl-adenosine
  modified_base 18: mod_base = OTHER; note = 2'-O-methyl-adenosine
  modified_base 19: mod_base = um
  modified_base 20: mod_base = um
  modified_base 21: mod_base = OTHER; note = 2'-O-methyl-adenosine
caatggatttcctaataatta

SEQ ID NO: 521 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = um
  modified_base 4: mod_base = gm
  modified_base 5: mod_base = um
  modified_base 6: mod_base = cm
  modified_base 7: mod_base = OTHER; note = 2'-Fluoro-uridine
  modified_base 8: mod_base = cm
  modified_base 9: mod_base = OTHER; note = 2'-Fluoro-uridine
  modified_base 10: mod_base = OTHER; note = 2'-Fluoro-guanosine
  modified_base 11: mod_base = OTHER; note = 2'-Fluoro-cytidine
  modified_base 12: mod_base = um
  modified_base 13: mod_base = cm
  modified_base 14: mod_base = um
  modified_base 15: mod_base = OTHER; note = 2'-O-methyl-adenosine
  modified_base 16: mod_base = OTHER; note = 2'-O-methyl-adenosine
  modified_base 17: mod_base = gm
  modified_base 18: mod_base = um
  modified_base 19: mod_base = OTHER; note = 2'-O-methyl-adenosine
  modified_base 20: mod_base = OTHER; note = 2'-O-methyl-adenosine
  modified_base 21: mod_base = OTHER; note = 2'-O-methyl-adenosine
ggtgtctctgctctaagtaaa

SEQ ID NO: 522 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = cm
  modified_base 4: mod_base = OTHER; note = 2'-O-methyl-adenosine
  modified_base 5: mod_base = OTHER; note = 2'-O-methyl-adenosine
  modified_base 6: mod_base = OTHER; note = 2'-O-methyl-adenosine
  modified_base 7: mod_base = OTHER; note = 2'-Fluoro-guanosine
  modified_base 8: mod_base = um
  modified_base 9: mod_base = OTHER; note = 2'-Fluoro-guanosine
  modified_base 10: mod_base = OTHER; note = 2'-Fluoro-cytidine
  modified_base 11: mod_base = OTHER; note = 2'-Fluoro-cytidine
  modified_base 12: mod_base = um
  modified_base 13: mod_base = um
  modified_base 14: mod_base = OTHER; note = 2'-O-methyl-adenosine
  modified_base 15: mod_base = OTHER; note = 2'-O-methyl-adenosine
  modified_base 16: mod_base = OTHER; note = 2'-O-methyl-adenosine
  modified_base 17: mod_base = OTHER; note = 2'-O-methyl-adenosine
  modified_base 18: mod_base = gm
  modified_base 19: mod_base = OTHER; note = 2'-O-methyl-adenosine
  modified_base 20: mod_base = OTHER; note = 2'-O-methyl-adenosine
  modified_base 21: mod_base = OTHER; note = 2'-O-methyl-adenosine
tccaaagtgccttaaaagaaa

SEQ ID NO: 523 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = um
  modified_base 4: mod_base = gm
  modified_base 5: mod_base = OTHER; note = 2'-O-methyl-adenosine
  modified_base 6: mod_base = OTHER; note = 2'-O-methyl-adenosine
  modified_base 7: mod_base = OTHER; note = 2'-Fluoro-uridine
  modified_base 8: mod_base = gm
  modified_base 9: mod_base = OTHER; note = 2'-Fluoro-uridine
  modified_base 10: mod_base = OTHER; note = 2'-Fluoro-guanosine
  modified_base 11: mod_base = OTHER; note = 2'-Fluoro-cytidine
  modified_base 12: mod_base = cm
  modified_base 13: mod_base = um
  modified_base 14: mod_base = um
  modified_base 15: mod_base = um
  modified_base 16: mod_base = um
  modified_base 17: mod_base = OTHER; note = 2'-O-methyl-adenosine
  modified_base 18: mod_base = OTHER; note = 2'-O-methyl-adenosine
  modified_base 19: mod_base = um
  modified_base 20: mod_base = um
  modified_base 21: mod_base = OTHER; note = 2'-O-methyl-adenosine
catgaatgtgccttttaatta

SEQ ID NO: 524 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = um
  modified_base 6: mod_base = um
  modified_base 7: mod_base = OTHER; note = 2'-Fluoro-guanosine
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-uridine
  modified_base 11: mod_base = OTHER; note = 2'-Fluoro-uridine
  modified_base 12: mod_base = um
  modified_base 13: mod_base = cm
  modified_base 14: mod_base = cm
  modified_base 15: mod_base = um
  modified_base 16: mod_base = OTHER; note = 2'-O-methyl-adenosine
  modified_base 17: mod_base = um
  modified_base 18: mod_base = gm
  modified_base 19: mod_base = um
  modified_base 20: mod_base = OTHER; note = 2'-O-methyl-adenosine
  modified_base 21: mod_base = um
aaacttgaatttcctatgtat

SEQ ID NO: 525 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = cm
  modified_base 4: mod_base = um
  modified_base 5: mod_base = gm
  modified_base 6: mod_base = OTHER; note = 2'-O-methyl-adenosine
  modified_base 7: mod_base = OTHER; note = 2'-Fluoro-cytidine
  modified_base 8: mod_base = um
  modified_base 9: mod_base = OTHER; note = 2'-Fluoro-uridine
  modified_base 10: mod_base = OTHER; note = 2'-Fluoro-uridine
  modified_base 11: mod_base = OTHER; note = 2'-Fluoro-uridine
  modified_base 12: mod_base = cm
  modified_base 13: mod_base = cm
  modified_base 14: mod_base = OTHER; note = 2'-O-methyl-adenosine
  modified_base 15: mod_base = OTHER; note = 2'-O-methyl-adenosine
  modified_base 16: mod_base = OTHER; note = 2'-O-methyl-adenosine
  modified_base 17: mod_base = gm
  modified_base 18: mod_base = um
  modified_base 19: mod_base = gm
  modified_base 20: mod_base = cm
  modified_base 21: mod_base = cm
tcctgacttttccaaagtgcc

SEQ ID NO: 526 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = cm
  modified_base 4: mod_base = OTHER; note = 2'-O-methyl-adenosine
  modified_base 5: mod_base = OTHER; note = 2'-O-methyl-adenosine
  modified_base 6: mod_base = um
  modified_base 7: mod_base = OTHER; note = 2'-Fluoro-guanosine
  modified_base 8: mod_base = gm
  modified_base 9: mod_base = OTHER; note = 2'-Fluoro-adenosine
  modified_base 10: mod_base = OTHER; note = 2'-Fluoro-uridine
  modified_base 11: mod_base = OTHER; note = 2'-Fluoro-uridine
  modified_base 12: mod_base = um
  modified_base 13: mod_base = cm
  modified_base 14: mod_base = cm
  modified_base 15: mod_base = um
  modified_base 16: mod_base = OTHER; note = 2'-O-methyl-adenosine
  modified_base 17: mod_base = OTHER; note = 2'-O-methyl-adenosine
  modified_base 18: mod_base = um
  modified_base 19: mod_base = OTHER; note = 2'-O-methyl-adenosine
  modified_base 20: mod_base = OTHER; note = 2'-O-methyl-adenosine
  modified_base 21: mod_base = um
atcaatggatttcctaataat

SEQ ID NO: 527 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = um
  modified_base 4: mod_base = um
  modified_base 5: mod_base = cm
  modified_base 6: mod_base = OTHER; note = 2'-O-methyl-adenosine
  modified_base 7: mod_base = OTHER; note = 2'-Fluoro-guanosine
  modified_base 8: mod_base = um
  modified_base 9: mod_base = OTHER; note = 2'-Fluoro-adenosine
  modified_base 10: mod_base = OTHER; note = 2'-Fluoro-uridine
  modified_base 11: mod_base = OTHER; note = 2'-Fluoro-uridine
  modified_base 12: mod_base = um
  modified_base 13: mod_base = um
  modified_base 14: mod_base = gm
  modified_base 15: mod_base = gm
  modified_base 16: mod_base = OTHER; note = 2'-O-methyl-adenosine
  modified_base 17: mod_base = gm
  modified_base 18: mod_base = gm
  modified_base 19: mod_base = um
  modified_base 20: mod_base = gm
  modified_base 21: mod_base = um
tgttcagtattttggaggtgt

SEQ ID NO: 528 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = cm
  modified_base 4: mod_base = cm
  modified_base 5: mod_base = um
  modified_base 6: mod_base = gm
  modified_base 7: mod_base = OTHER; note = 2'-Fluoro-adenosine
  modified_base 8: mod_base = cm
  modified_base 9: mod_base = OTHER; note = 2'-Fluoro-uridine
  modified_base 10: mod_base = OTHER; note = 2'-Fluoro-uridine
  modified_base 11: mod_base = OTHER; note = 2'-Fluoro-uridine
  modified_base 12: mod_base = um
  modified_base 13: mod_base = cm
  modified_base 14: mod_base = cm
  modified_base 15: mod_base = OTHER; note = 2'-O-methyl-adenosine
  modified_base 16: mod_base = OTHER; note = 2'-O-methyl-adenosine
  modified_base 17: mod_base = OTHER; note = 2'-O-methyl-adenosine
  modified_base 18: mod_base = gm
  modified_base 19: mod_base = um
  modified_base 20: mod_base = gm
  modified_base 21: mod_base = cm
atcctgacttttccaaagtgc

SEQ ID NO: 529 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = gm
  modified_base 4: mod_base = gm
  modified_base 5: mod_base = OTHER; note = 2'-O-methyl-adenosine
  modified_base 6: mod_base = um
  modified_base 7: mod_base = OTHER; note = 2'-Fluoro-uridine
  modified_base 8: mod_base = um
  modified_base 9: mod_base = OTHER; note = 2'-Fluoro-cytidine
  modified_base 10: mod_base = OTHER; note = 2'-Fluoro-cytidine
  modified_base 11: mod_base = OTHER; note = 2'-Fluoro-uridine
  modified_base 12: mod_base = OTHER; note = 2'-O-methyl-adenosine
  modified_base 13: mod_base = OTHER; note = 2'-O-methyl-adenosine
  modified_base 14: mod_base = um
  modified_base 15: mod_base = OTHER; note = 2'-O-methyl-adenosine
  modified_base 16: mod_base = OTHER; note = 2'-O-methyl-adenosine
  modified_base 17: mod_base = um
  modified_base 18: mod_base = um
  modified_base 19: mod_base = OTHER; note = 2'-O-methyl-adenosine
  modified_base 20: mod_base = um
  modified_base 21: mod_base = um
atggatttcctaataattatt

SEQ ID NO: 530 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = cm
  modified_base 4: mod_base = OTHER; note = 2'-O-methyl-adenosine
  modified_base 5: mod_base = um
  modified_base 6: mod_base = gm
  modified_base 7: mod_base = OTHER; note = 2'-Fluoro-adenosine
  modified_base 8: mod_base = OTHER; note = 2'-O-methyl-adenosine
  modified_base 9: mod_base = OTHER; note = 2'-Fluoro-uridine
  modified_base 10: mod_base = OTHER; note = 2'-Fluoro-guanosine
  modified_base 11: mod_base = OTHER; note = 2'-Fluoro-uridine
  modified_base 12: mod_base = gm
  modified_base 13: mod_base = cm
  modified_base 14: mod_base = cm
  modified_base 15: mod_base = um
  modified_base 16: mod_base = um
  modified_base 17: mod_base = um
  modified_base 18: mod_base = um
  modified_base 19: mod_base = OTHER; note = 2'-O-methyl-adenosine
  modified_base 20: mod_base = OTHER; note = 2'-O-methyl-adenosine
  modified_base 21: mod_base = um
agcatgaatgtgccttttaat

SEQ ID NO: 531 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = um
  modified_base 4: mod_base = cm
  modified_base 5: mod_base = um
  modified_base 6: mod_base = cm
  modified_base 7: mod_base = OTHER; note = 2'-Fluoro-uridine
  modified_base 8: mod_base = gm
  modified_base 9: mod_base = OTHER; note = 2'-Fluoro-cytidine
  modified_base 10: mod_base = OTHER; note = 2'-Fluoro-uridine
  modified_base 11: mod_base = OTHER; note = 2'-Fluoro-cytidine
  modified_base 12: mod_base = um
  modified_base 13: mod_base = OTHER; note = 2'-O-methyl-adenosine
  modified_base 14: mod_base = OTHER; note = 2'-O-methyl-adenosine
  modified_base 15: mod_base = gm
  modified_base 16: mod_base = um
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20: mod_base = cm
  modified_base 21: mod_base = OTHER; note = 2'-O-methyl-adenosine
tgtctctgctctaagtaaaca

SEQ ID NO: 532 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = gm
  modified_base 4: mod_base = um
  modified_base 5: mod_base = um
  modified_base 6: mod_base = cm
  modified_base 7: mod_base = OTHER; note = 2'-Fluoro-adenosine
  modified_base 8: mod_base = gm
  modified_base 9: mod_base = OTHER; note = 2'-Fluoro-uridine
  modified_base 10: mod_base = OTHER; note = 2'-Fluoro-adenosine
  modified_base 11: mod_base = OTHER; note = 2'-Fluoro-uridine
  modified_base 12: mod_base = um
  modified_base 13: mod_base = um
  modified_base 14: mod_base = um
  modified_base 15: mod_base = gm
  modified_base 16: mod_base = gm
  modified_base 17: mod_base = OTHER; note = 2'-O-methyl-adenosine
  modified_base 18: mod_base = gm
  modified_base 19: mod_base = gm
  modified_base 20: mod_base = um
  modified_base 21: mod_base = gm
atgttcagtattttggaggtg

SEQ ID NO: 533 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = um
  modified_base 4: mod_base = cm
  modified_base 5: mod_base = cm
  modified_base 6: mod_base = um
  modified_base 7: mod_base = OTHER; note = 2'-Fluoro-guanosine
  modified_base 8: mod_base = OTHER; note = 2'-O-methyl-adenosine
  modified_base 9: mod_base = OTHER; note = 2'-Fluoro-cytidine
  modified_base 10: mod_base = OTHER; note = 2'-Fluoro-uridine
  modified_base 11: mod_base = OTHER; note = 2'-Fluoro-uridine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyl-adenosine
  modified_base 17: mod_base = OTHER; note = 2'-O-methyl-adenosine
  modified_base 18: mod_base = OTHER; note = 2'-O-methyl-adenosine
  modified_base 19: mod_base = gm
  modified_base 20: mod_base = um
  modified_base 21: mod_base = gm
gatcctgacttttccaaagtg

SEQ ID NO: 534 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = gm
  modified_base 4: mod_base = cm
  modified_base 5: mod_base = um
  modified_base 6: mod_base = OTHER; note = 2'-O-methyl-adenosine
  modified_base 7: mod_base = OTHER; note = 2'-Fluoro-uridine
  modified_base 8: mod_base = gm
  modified_base 9: mod_base = OTHER; note = 2'-Fluoro-uridine
  modified_base 10: mod_base = OTHER; note = 2'-Fluoro-adenosine
  modified_base 11: mod_base = OTHER; note = 2'-Fluoro-adenosine
  modified_base 12: mod_base = OTHER; note = 2'-O-methyl-adenosine
  modified_base 13: mod_base = cm
  modified_base 14: mod_base = um
  modified_base 15: mod_base = um
  modified_base 16: mod_base = gm
  modified_base 17: mod_base = OTHER; note = 2'-O-methyl-adenosine
  modified_base 18: mod_base = OTHER; note = 2'-O-methyl-adenosine
  modified_base 19: mod_base = um
  modified_base 20: mod_base = um
  modified_base 21: mod_base = um
atgctatgtaaacttgaattt

SEQ ID NO: 535 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = um
  modified_base 4: mod_base = cm
  modified_base 5: mod_base = um
  modified_base 6: mod_base = OTHER; note = 2'-O-methyl-adenosine
  modified_base 7: mod_base = OTHER; note = 2'-Fluoro-adenosine
  modified_base 8: mod_base = gm
  modified_base 9: mod_base = OTHER; note = 2'-Fluoro-uridine
  modified_base 10: mod_base = OTHER; note = 2'-Fluoro-adenosine
  modified_base 11: mod_base = OTHER; note = 2'-Fluoro-adenosine
  modified_base 12: mod_base = OTHER; note = 2'-O-methyl-adenosine
  modified_base 13: mod_base = cm
  modified_base 14: mod_base = OTHER; note = 2'-O-methyl-adenosine
  modified_base 15: mod_base = OTHER; note = 2'-O-methyl-adenosine
  modified_base 16: mod_base = cm
  modified_base 17: mod_base = OTHER; note = 2'-O-methyl-adenosine
  modified_base 18: mod_base = gm
  modified_base 19: mod_base = um
  modified_base 20: mod_base = um
  modified_base 21: mod_base = um
gctctaagtaaacaacagttt

SEQ ID NO: 536 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = um
  modified_base 4: mod_base = gm
  modified_base 5: mod_base = gm
  modified_base 6: mod_base = OTHER; note = 2'-O-methyl-adenosine
  modified_base 7: mod_base = OTHER; note = 2'-Fluoro-uridine
  modified_base 8: mod_base = gm
  modified_base 9: mod_base = OTHER; note = 2'-Fluoro-uridine
  modified_base 10: mod_base = OTHER; note = 2'-Fluoro-adenosine
  modified_base 11: mod_base = OTHER; note = 2'-Fluoro-cytidine
  modified_base 12: mod_base = OTHER; note = 2'-O-methyl-adenosine
  modified_base 13: mod_base = gm
  modified_base 14: mod_base = OTHER; note = 2'-O-methyl-adenosine
  modified_base 15: mod_base = gm
  modified_base 16: mod_base = OTHER; note = 2'-O-methyl-adenosine
  modified_base 17: mod_base = um
  modified_base 18: mod_base = OTHER; note = 2'-O-methyl-adenosine
  modified_base 19: mod_base = cm
  modified_base 20: mod_base = cm
  modified_base 21: mod_base = cm
gctggatgtacagagataccc

SEQ ID NO: 537 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = um
  modified_base 4: mod_base = cm
  modified_base 5: mod_base = um
  modified_base 6: mod_base = gm
  modified_base 7: mod_base = OTHER; note = 2'-Fluoro-cytidine
  modified_base 8: mod_base = um
  modified_base 9: mod_base = OTHER; note = 2'-Fluoro-cytidine
  modified_base 10: mod_base = OTHER; note = 2'-Fluoro-uridine
  modified_base 11: mod_base = OTHER; note = 2'-Fluoro-adenosine
  modified_base 12: mod_base = OTHER; note = 2'-O-methyl-adenosine
  modified_base 13: mod_base = gm
  modified_base 14: mod_base = um
  modified_base 15: mod_base = OTHER; note = 2'-O-methyl-adenosine
  modified_base 16: mod_base = OTHER; note = 2'-O-methyl-adenosine
  modified_base 17: mod_base = OTHER; note = 2'-O-methyl-adenosine
  modified_base 18: mod_base = cm
  modified_base 19: mod_base = OTHER; note = 2'-O-methyl-adenosine
  modified_base 20: mod_base = OTHER; note = 2'-O-methyl-adenosine
  modified_base 21: mod_base = cm
tctctgctctaagtaaacaac

SEQ ID NO: 538 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = um
  modified_base 4: mod_base = gm
  modified_base 5: mod_base = um
  modified_base 6: mod_base = OTHER; note = 2'-O-methyl-adenosine
  modified_base 7: mod_base = OTHER; note = 2'-Fluoro-adenosine
  modified_base 8: mod_base = OTHER; note = 2'-O-methyl-adenosine
  modified_base 9: mod_base = OTHER; note = 2'-Fluoro-cytidine
  modified_base 10: mod_base = OTHER; note = 2'-Fluoro-uridine
  modified_base 11: mod_base = OTHER; note = 2'-Fluoro-uridine
  modified_base 12: mod_base = gm
  modified_base 13: mod_base = OTHER; note = 2'-O-methyl-adenosine
  modified_base 14: mod_base = OTHER; note = 2'-O-methyl-adenosine
  modified_base 15: mod_base = um
  modified_base 16: mod_base = um
  modified_base 17: mod_base = um
  modified_base 18: mod_base = cm
  modified_base 19: mod_base = cm
  modified_base 20: mod_base = um
  modified_base 21: mod_base = OTHER; note = 2'-O-methyl-adenosine
tatgtaaacttgaatttccta

SEQ ID NO: 539 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = cm
  modified_base 4: mod_base = cm
  modified_base 5: mod_base = cm
  modified_base 6: mod_base = OTHER; note = 2'-O-methyl-adenosine
  modified_base 7: mod_base = OTHER; note = 2'-Fluoro-adenosine
  modified_base 8: mod_base = OTHER; note = 2'-O-methyl-adenosine
  modified_base 9: mod_base = OTHER; note = 2'-Fluoro-uridine
  modified_base 10: mod_base = OTHER; note = 2'-Fluoro-cytidine
  modified_base 11: mod_base = OTHER; note = 2'-Fluoro-adenosine
  modified_base 12: mod_base = cm
  modified_base 13: mod_base = OTHER; note = 2'-O-methyl-adenosine
  modified_base 14: mod_base = gm
  modified_base 15: mod_base = um
  modified_base 16: mod_base = gm
  modified_base 17: mod_base = gm
  modified_base 18: mod_base = OTHER; note = 2'-O-methyl-adenosine
  modified_base 19: mod_base = cm
  modified_base 20: mod_base = OTHER; note = 2'-O-methyl-adenosine
  modified_base 21: mod_base = um
tacccaaatcacagtggacat

SEQ ID NO: 540 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = cm
  modified_base 4: mod_base = um
  modified_base 5: mod_base = cm
  modified_base 6: mod_base = OTHER; note = 2'-O-methyl-adenosine
  modified_base 7: mod_base = OTHER; note = 2'-Fluoro-guanosine
  modified_base 8: mod_base = OTHER; note = 2'-O-methyl-adenosine
  modified_base 9: mod_base = OTHER; note = 2'-Fluoro-guanosine
  modified_base 10: mod_base = OTHER; note = 2'-Fluoro-guanosine
  modified_base 11: mod_base = OTHER; note = 2'-Fluoro-uridine
  modified_base 12: mod_base = um
  modified_base 13: mod_base = um
  modified_base 14: mod_base = gm
  modified_base 15: mod_base = OTHER; note = 2'-O-methyl-adenosine
  modified_base 16: mod_base = cm
  modified_base 17: mod_base = cm
  modified_base 18: mod_base = gm
  modified_base 19: mod_base = OTHER; note = 2'-O-methyl-adenosine
  modified_base 20: mod_base = OTHER; note = 2'-O-methyl-adenosine
  modified_base 21: mod_base = um
tcctcagaggtttgaccgaat

SEQ ID NO: 541 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = um
  modified_base 4: mod_base = um
  modified_base 5: mod_base = gm
  modified_base 6: mod_base = OTHER; note = 2'-O-methyl-adenosine
  modified_base 7: mod_base = OTHER; note = 2'-Fluoro-adenosine
  modified_base 8: mod_base = um
  modified_base 9: mod_base = OTHER; note = 2'-Fluoro-uridine
  modified_base 10: mod_base = OTHER; note = 2'-Fluoro-uridine
  modified_base 11: mod_base = OTHER; note = 2'-Fluoro-cytidine
  modified_base 12: mod_base = cm
  modified_base 13: mod_base = um
  modified_base 14: mod_base = OTHER; note = 2'-O-methyl-adenosine
  modified_base 15: mod_base = um
  modified_base 16: mod_base = gm
  modified_base 17: mod_base = um
  modified_base 18: mod_base = OTHER; note = 2'-O-methyl-adenosine
  modified_base 19: mod_base = um
  modified_base 20: mod_base = um
  modified_base 21: mod_base = um
acttgaatttcctatgtattt

SEQ ID NO: 542 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = gm
  modified_base 4: mod_base = OTHER; note = 2'-O-methyl-adenosine
  modified_base 5: mod_base = OTHER; note = 2'-O-methyl-adenosine
  modified_base 6: mod_base = um
  modified_base 7: mod_base = OTHER; note = 2'-Fluoro-guanosine
  modified_base 8: mod_base = um
  modified_base 9: mod_base = OTHER; note = 2'-Fluoro-guanosine
  modified_base 10: mod_base = OTHER; note = 2'-Fluoro-cytidine
  modified_base 11: mod_base = OTHER; note = 2'-Fluoro-cytidine
  modified_base 12: mod_base = um
  modified_base 13: mod_base = um
  modified_base 14: mod_base = um
  modified_base 15: mod_base = um
  modified_base 16: mod_base = OTHER; note = 2'-O-methyl-adenosine
  modified_base 17: mod_base = OTHER; note = 2'-O-methyl-adenosine
  modified_base 18: mod_base = um
  modified_base 19: mod_base = um
  modified_base 20: mod_base = OTHER; note = 2'-O-methyl-adenosine
  modified_base 21: mod_base = gm
atgaatgtgccttttaattag

SEQ ID NO: 543 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = gm
  modified_base 4: mod_base = um
  modified_base 5: mod_base = cm
  modified_base 6: mod_base = um
  modified_base 7: mod_base = OTHER; note = 2'-Fluoro-cytidine
  modified_base 8: mod_base = um
  modified_base 9: mod_base = OTHER; note = 2'-Fluoro-cytidine
  modified_base 10: mod_base = OTHER; note = 2'-Fluoro-cytidine
  modified_base 11: mod_base = OTHER; note = 2'-Fluoro-uridine
  modified_base 12: mod_base = cm
  modified_base 13: mod_base = OTHER; note = 2'-O-methyl-adenosine
  modified_base 14: mod_base = cm
  modified_base 15: mod_base = OTHER; note = 2'-O-methyl-adenosine
  modified_base 16: mod_base = OTHER; note = 2'-O-methyl-adenosine
  modified_base 17: mod_base = gm
  modified_base 18: mod_base = gm
  modified_base 19: mod_base = um
  modified_base 20: mod_base = gm
  modified_base 21: mod_base = gm
gcgtctctcctcacaaggtgg

SEQ ID NO: 544 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = cm
  modified_base 6: mod_base = cm
  modified_base 7: mod_base = OTHER; note = 2'-Fluoro-adenosine
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-uridine
  modified_base 11: mod_base = OTHER; note = 2'-Fluoro-cytidine
  modified_base 12: mod_base = OTHER; note = 2'-O-methyl-adenosine
  modified_base 13: mod_base = cm
  modified_base 14: mod_base = OTHER; note = 2'-O-methyl-adenosine
  modified_base 15: mod_base = gm
  modified_base 16: mod_base = um
  modified_base 17: mod_base = gm
  modified_base 18: mod_base = gm
  modified_base 19: mod_base = OTHER; note = 2'-O-methyl-adenosine
  modified_base 20: mod_base = cm
  modified_base 21: mod_base = OTHER; note = 2'-O-methyl-adenosine
atacccaaatcacagtggaca

SEQ ID NO: 545 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-O-methyl-adenosine
  modified_base 5: mod_base = cm
  modified_base 6: mod_base = um
  modified_base 7: mod_base = OTHER; note = 2'-Fluoro-uridine
  modified_base 8: mod_base = gm
  modified_base 9: mod_base = OTHER; note = 2'-Fluoro-adenosine
  modified_base 10: mod_base = OTHER; note = 2'-Fluoro-adenosine
  modified_base 11: mod_base = OTHER; note = 2'-Fluoro-uridine
  modified_base 12: mod_base = um
  modified_base 13: mod_base = um
  modified_base 14: mod_base = cm
  modified_base 15: mod_base = cm
  modified_base 16: mod_base = um
  modified_base 17: mod_base = OTHER; note = 2'-O-methyl-adenosine
  modified_base 18: mod_base = um
  modified_base 19: mod_base = gm
  modified_base 20: mod_base = um
  modified_base 21: mod_base = OTHER; note = 2'-O-methyl-adenosine
taaacttgaatttcctatgta

SEQ ID NO: 546 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = cm
  modified_base 4: mod_base = um
  modified_base 5: mod_base = gm
  modified_base 6: mod_base = OTHER; note = 2'-O-methyl-adenosine
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = OTHER; note = 2'-Fluoro-cytidine
  modified_base 11: mod_base = OTHER; note = 2'-Fluoro-uridine
  modified_base 12: mod_base = gm
  modified_base 13: mod_base = OTHER; note = 2'-O-methyl-adenosine
  modified_base 14: mod_base = OTHER; note = 2'-O-methyl-adenosine
  modified_base 15: mod_base = um
  modified_base 16: mod_base = gm
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
gtctgatttctgaatgtaaag

SEQ ID NO: 547 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = um
  modified_base 6: mod_base = um
  modified_base 7: mod_base = OTHER; note = 2'-Fluoro-cytidine
  modified_base 8: mod_base = cm
  modified_base 9: mod_base = OTHER; note = 2'-Fluoro-uridine
  modified_base 10: mod_base = OTHER; note = 2'-Fluoro-adenosine
  modified_base 11: mod_base = OTHER; note = 2'-Fluoro-adenosine
  modified_base 12: mod_base = um
  modified_base 13: mod_base = OTHER; note = 2'-O-methyl-adenosine
  modified_base 14: mod_base = OTHER; note = 2'-O-methyl-adenosine
  modified_base 15: mod_base = um
  modified_base 16: mod_base = um
  modified_base 17: mod_base = OTHER; note = 2'-O-methyl-adenosine
  modified_base 18: mod_base = um
  modified_base 19: mod_base = um
  modified_base 20: mod_base = gm
  modified_base 21: mod_base = gm
ggatttcctaataattattgg

SEQ ID NO: 548 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = cm
  modified_base 5: mod_base = cm
  modified_base 6: mod_base = gm
  modified_base 7: mod_base = OTHER; note = 2'-Fluoro-cytidine
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-cytidine
  modified_base 11: mod_base = OTHER; note = 2'-Fluoro-cytidine
  modified_base 12: mod_base = gm
  modified_base 13: mod_base = gm
  modified_base 14: mod_base = cm
  modified_base 15: mod_base = OTHER; note = 2'-O-methyl-adenosine
  modified_base 16: mod_base = gm
  modified_base 17: mod_base = gm
  modified_base 18: mod_base = OTHER; note = 2'-O-methyl-adenosine
  modified_base 19: mod_base = gm
  modified_base 20: mod_base = cm
  modified_base 21: mod_base = OTHER; note = 2'-O-methyl-adenosine
attccgcaaccggcaggagca

SEQ ID NO: 549 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = cm
  modified_base 4: mod_base = um
  modified_base 5: mod_base = cm
  modified_base 6: mod_base = um
  modified_base 7: mod_base = OTHER; note = 2'-Fluoro-guanosine
  modified_base 8: mod_base = cm
  modified_base 9: mod_base = OTHER; note = 2'-Fluoro-uridine
  modified_base 10: mod_base = OTHER; note = 2'-Fluoro-cytidine
  modified_base 11: mod_base = OTHER; note = 2'-Fluoro-uridine
  modified_base 12: mod_base = OTHER; note = 2'-O-methyl-adenosine
  modified_base 13: mod_base = OTHER; note = 2'-O-methyl-adenosine
  modified_base 14: mod_base = gm
  modified_base 15: mod_base = um
  modified_base 16: mod_base = OTHER; note = 2'-O-methyl-adenosine
  modified_base 17: mod_base = OTHER; note = 2'-O-methyl-adenosine
  modified_base 18: mod_base = OTHER; note = 2'-O-methyl-adenosine
  modified_base 19: mod_base = cm
  modified_base 20: mod_base = OTHER; note = 2'-O-methyl-adenosine
  modified_base 21: mod_base = OTHER; note = 2'-O-methyl-adenosine
gtctctgctctaagtaaacaa

SEQ ID NO: 550 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = gm
  modified_base 4: mod_base = cm
  modified_base 5: mod_base = um
  modified_base 6: mod_base = cm
  modified_base 7: mod_base = OTHER; note = 2'-Fluoro-uridine
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-guanosine
  modified_base 11: mod_base = OTHER; note = 2'-Fluoro-uridine
  modified_base 12: mod_base = OTHER; note = 2'-O-methyl-adenosine
  modified_base 13: mod_base = OTHER; note = 2'-O-methyl-adenosine
  modified_base 14: mod_base = OTHER; note = 2'-O-methyl-adenosine
  modified_base 15: mod_base = cm
  modified_base 16: mod_base = OTHER; note = 2'-O-methyl-adenosine
  modified_base 17: mod_base = OTHER; note = 2'-O-methyl-adenosine
  modified_base 18: mod_base = cm
  modified_base 19: mod_base = OTHER; note = 2'-O-methyl-adenosine
  modified_base 20: mod_base = gm
  modified_base 21: mod_base = um
ctgctctaagtaaacaacagt

SEQ ID NO: 551 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = um
  modified_base 5: mod_base = cm
  modified_base 6: mod_base = cm
  modified_base 7: mod_base = OTHER; note = 2'-Fluoro-adenosine
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-guanosine
  modified_base 11: mod_base = OTHER; note = 2'-Fluoro-uridine
  modified_base 12: mod_base = gm
  modified_base 13: mod_base = cm
  modified_base 14: mod_base = cm
  modified_base 15: mod_base = um
  modified_base 16: mod_base = um
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = gm
ttttccaaagtgccttaaaag

SEQ ID NO: 552 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = um
  modified_base 4: mod_base = gm
  modified_base 5: mod_base = um
  modified_base 6: mod_base = um
  modified_base 7: mod_base = OTHER; note = 2'-Fluoro-cytidine
  modified_base 8: mod_base = OTHER; note = 2'-O-methyl-adenosine
  modified_base 9: mod_base = OTHER; note = 2'-Fluoro-guanosine
  modified_base 10: mod_base = OTHER; note = 2'-Fluoro-uridine
  modified_base 11: mod_base = OTHER; note = 2'-Fluoro-adenosine
  modified_base 12: mod_base = um
  modified_base 13: mod_base = um
  modified_base 14: mod_base = um
  modified_base 15: mod_base = um
  modified_base 16: mod_base = gm
  modified_base 17: mod_base = gm
  modified_base 18: mod_base = OTHER; note = 2'-O-methyl-adenosine
  modified_base 19: mod_base = gm
  modified_base 20: mod_base = gm
  modified_base 21: mod_base = um
tatgttcagtattttggaggt

SEQ ID NO: 553 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = OTHER; note = 2'-O-methyl-adenosine
  modified_base 4: mod_base = gm
  modified_base 5: mod_base = um
  modified_base 6: mod_base = gm
  modified_base 7: mod_base = OTHER; note = 2'-Fluoro-guanosine
  modified_base 8: mod_base = OTHER; note = 2'-O-methyl-adenosine
  modified_base 9: mod_base = OTHER; note = 2'-Fluoro-cytidine
  modified_base 10: mod_base = OTHER; note = 2'-Fluoro-adenosine
  modified_base 11: mod_base = OTHER; note = 2'-Fluoro-uridine
  modified_base 12: mod_base = cm
  modified_base 13: mod_base = gm
  modified_base 14: mod_base = gm
  modified_base 15: mod_base = gm
  modified_base 16: mod_base = OTHER; note = 2'-O-methyl-adenosine
  modified_base 17: mod_base = cm
  modified_base 18: mod_base = OTHER; note = 2'-O-methyl-adenosine
  modified_base 19: mod_base = cm
  modified_base 20: mod_base = cm
  modified_base 21: mod_base = gm
acagtggacatcgggacaccg

SEQ ID NO: 554 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = um
  modified_base 5: mod_base = cm
  modified_base 6: mod_base = cm
  modified_base 7: mod_base = OTHER; note = 2'-Fluoro-uridine
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-uridine
  modified_base 11: mod_base = OTHER; note = 2'-Fluoro-adenosine
  modified_base 12: mod_base = OTHER; note = 2'-O-methyl-adenosine
  modified_base 13: mod_base = um
  modified_base 14: mod_base = um
  modified_base 15: mod_base = OTHER; note = 2'-O-methyl-adenosine
  modified_base 16: mod_base = um
  modified_base 17: mod_base = um
  modified_base 18: mod_base = gm
  modified_base 19: mod_base = gm
  modified_base 20: mod_base = gm
  modified_base 21: mod_base = gm
atttcctaataattattgggg

SEQ ID NO: 555 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = cm
  modified_base 4: mod_base = cm
  modified_base 5: mod_base = OTHER; note = 2'-O-methyl-adenosine
  modified_base 6: mod_base = OTHER; note = 2'-O-methyl-adenosine
  modified_base 7: mod_base = OTHER; note = 2'-Fluoro-adenosine
  modified_base 8: mod_base = um
  modified_base 9: mod_base = OTHER; note = 2'-Fluoro-cytidine
  modified_base 10: mod_base = OTHER; note = 2'-Fluoro-adenosine
  modified_base 11: mod_base = OTHER; note = 2'-Fluoro-cytidine
  modified_base 12: mod_base = OTHER; note = 2'-O-methyl-adenosine
  modified_base 13: mod_base = gm
  modified_base 14: mod_base = um
  modified_base 15: mod_base = gm
  modified_base 16: mod_base = gm
  modified_base 17: mod_base = OTHER; note = 2'-O-methyl-adenosine
  modified_base 18: mod_base = cm
  modified_base 19: mod_base = OTHER; note = 2'-O-methyl-adenosine
  modified_base 20: mod_base = um
  modified_base 21: mod_base = cm
acccaaatcacagtggacatc

SEQ ID NO: 556 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = gm
  modified_base 5: mod_base = gm
  modified_base 6: mod_base = OTHER; note = 2'-O-methyl-adenosine
  modified_base 7: mod_base = OTHER; note = 2'-Fluoro-guanosine
  modified_base 8: mod_base = gm
  modified_base 9: mod_base = OTHER; note = 2'-Fluoro-uridine
  modified_base 10: mod_base = OTHER; note = 2'-Fluoro-guanosine
  modified_base 11: mod_base = OTHER; note = 2'-Fluoro-uridine
  modified_base 12: mod_base = cm
  modified_base 13: mod_base = um
  modified_base 14: mod_base = cm
  modified_base 15: mod_base = um
  modified_base 16: mod_base = gm
  modified_base 17: mod_base = cm
  modified_base 18: mod_base = um
  modified_base 19: mod_base = cm
  modified_base 20: mod_base = um
  modified_base 21: mod_base = OTHER; note = 2'-O-methyl-adenosine
tttggaggtgtctctgctcta

SEQ ID NO: 557 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-O-methyl-adenosine
  modified_base 5: mod_base = OTHER; note = 2'-O-methyl-adenosine
  modified_base 6: mod_base = um
  modified_base 7: mod_base = OTHER; note = 2'-Fluoro-cytidine
  modified_base 8: mod_base = OTHER; note = 2'-O-methyl-adenosine
  modified_base 9: mod_base = OTHER; note = 2'-Fluoro-cytidine
  modified_base 10: mod_base = OTHER; note = 2'-Fluoro-adenosine
  modified_base 11: mod_base = OTHER; note = 2'-Fluoro-guanosine
  modified_base 12: mod_base = um
  modified_base 13: mod_base = gm
  modified_base 14: mod_base = gm
  modified_base 15: mod_base = OTHER; note = 2'-O-methyl-adenosine
  modified_base 16: mod_base = cm
  modified_base 17: mod_base = OTHER; note = 2'-O-methyl-adenosine
  modified_base 18: mod_base = um
  modified_base 19: mod_base = cm
  modified_base 20: mod_base = gm
  modified_base 21: mod_base = gm
ccaaatcacagtggacatcgg

SEQ ID NO: 558 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = cm
  modified_base 5: mod_base = cm
  modified_base 6: mod_base = OTHER; note = 2'-O-methyl-adenosine
  modified_base 7: mod_base = OTHER; note = 2'-Fluoro-adenosine
  modified_base 8: mod_base = OTHER; note = 2'-O-methyl-adenosine
  modified_base 9: mod_base = OTHER; note = 2'-Fluoro-guanosine
  modified_base 10: mod_base = OTHER; note = 2'-Fluoro-uridine
  modified_base 11: mod_base = OTHER; note = 2'-Fluoro-guanosine
  modified_base 12: mod_base = cm
  modified_base 13: mod_base = cm
  modified_base 14: mod_base = um
  modified_base 15: mod_base = um
  modified_base 16: mod_base = OTHER; note = 2'-O-methyl-adenosine
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20: mod_base = gm
  modified_base 21: mod_base = OTHER; note = 2'-O-methyl-adenosine
tttccaaagtgccttaaaaga

SEQ ID NO: 559 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = um
  modified_base 4: mod_base = um
  modified_base 5: mod_base = um
  modified_base 6: mod_base = cm
  modified_base 7: mod_base = OTHER; note = 2'-Fluoro-cytidine
  modified_base 8: mod_base = um
  modified_base 9: mod_base = OTHER; note = 2'-Fluoro-adenosine
  modified_base 10: mod_base = OTHER; note = 2'-Fluoro-adenosine
  modified_base 11: mod_base = OTHER; note = 2'-Fluoro-uridine
  modified_base 12: mod_base = OTHER; note = 2'-O-methyl-adenosine
  modified_base 13: mod_base = OTHER; note = 2'-O-methyl-adenosine
  modified_base 14: mod_base = um
  modified_base 15: mod_base = um
  modified_base 16: mod_base = OTHER; note = 2'-O-methyl-adenosine
  modified_base 17: mod_base = um
  modified_base 18: mod_base = um
  modified_base 19: mod_base = gm
  modified_base 20: mod_base = gm
  modified_base 21: mod_base = gm
gatttcctaataattattggg

SEQ ID NO: 560 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = um
  modified_base 4: mod_base = OTHER; note = 2'-O-methyl-adenosine
  modified_base 5: mod_base = cm
  modified_base 6: mod_base = cm
  modified_base 7: mod_base = OTHER; note = 2'-Fluoro-cytidine
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-adenosine
  modified_base 11: mod_base = OTHER; note = 2'-Fluoro-uridine
  modified_base 12: mod_base = cm
  modified_base 13: mod_base = OTHER; note = 2'-O-methyl-adenosine
  modified_base 14: mod_base = cm
  modified_base 15: mod_base = OTHER; note = 2'-O-methyl-adenosine
  modified_base 16: mod_base = gm
  modified_base 17: mod_base = um
  modified_base 18: mod_base = gm
  modified_base 19: mod_base = gm
  modified_base 20: mod_base = OTHER; note = 2'-O-methyl-adenosine
  modified_base 21: mod_base = cm
tatacccaaatcacagtggac

SEQ ID NO: 561 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = um
  modified_base 4: mod_base = um
  modified_base 5: mod_base = um
  modified_base 6: mod_base = gm
  modified_base 7: mod_base = OTHER; note = 2'-Fluoro-adenosine
  modified_base 8: mod_base = OTHER; note = 2'-O-methyl-adenosine
  modified_base 9: mod_base = OTHER; note = 2'-Fluoro-cytidine
  modified_base 10: mod_base = OTHER; note = 2'-Fluoro-uridine
  modified_base 11: mod_base = OTHER; note = 2'-Fluoro-cytidine
  modified_base 12: mod_base = OTHER; note = 2'-O-methyl-adenosine
  modified_base 13: mod_base = cm
  modified_base 14: mod_base = um
  modified_base 15: mod_base = cm
  modified_base 16: mod_base = OTHER; note = 2'-O-methyl-adenosine
  modified_base 17: mod_base = cm
  modified_base 18: mod_base = cm
  modified_base 19: mod_base = um
  modified_base 20: mod_base = OTHER; note = 2'-O-methyl-adenosine
  modified_base 21: mod_base = cm
ggtttgaactcactcacctac

SEQ ID NO: 562 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = OTHER; note = 2'-O-methyl-adenosine
  modified_base 4: mod_base = gm
  modified_base 5: mod_base = gm
  modified_base 6: mod_base = um
  modified_base 7: mod_base = OTHER; note = 2'-Fluoro-guanosine
  modified_base 8: mod_base = um
  modified_base 9: mod_base = OTHER; note = 2'-Fluoro-cytidine
  modified_base 10: mod_base = OTHER; note = 2'-Fluoro-uridine
  modified_base 11: mod_base = OTHER; note = 2'-Fluoro-cytidine
  modified_base 12: mod_base = um
  modified_base 13: mod_base = gm
  modified_base 14: mod_base = cm
  modified_base 15: mod_base = um
  modified_base 16: mod_base = cm
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20: mod_base = gm
  modified_base 21: mod_base = um
ggaggtgtctctgctctaagt

SEQ ID NO: 563 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = cm
  modified_base 4: mod_base = gm
  modified_base 5: mod_base = um
  modified_base 6: mod_base = cm
  modified_base 7: mod_base = OTHER; note = 2'-Fluoro-uridine
  modified_base 8: mod_base = cm
  modified_base 9: mod_base = OTHER; note = 2'-Fluoro-uridine
  modified_base 10: mod_base = OTHER; note = 2'-Fluoro-cytidine
  modified_base 11: mod_base = OTHER; note = 2'-Fluoro-cytidine
  modified_base 12: mod_base = um
  modified_base 13: mod_base = cm
  modified_base 14: mod_base = OTHER; note = 2'-O-methyl-adenosine
  modified_base 15: mod_base = cm
  modified_base 16: mod_base = OTHER; note = 2'-O-methyl-adenosine
  modified_base 17: mod_base = OTHER; note = 2'-O-methyl-adenosine
  modified_base 18: mod_base = gm
  modified_base 19: mod_base = gm
  modified_base 20: mod_base = um
  modified_base 21: mod_base = gm
tgcgtctctcctcacaaggtg

SEQ ID NO: 564 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = gm
  modified_base 4: mod_base = OTHER; note = 2'-O-methyl-adenosine
  modified_base 5: mod_base = gm
  modified_base 6: mod_base = OTHER; note = 2'-O-methyl-adenosine
  modified_base 7: mod_base = OTHER; note = 2'-Fluoro-adenosine
  modified_base 8: mod_base = gm
  modified_base 9: mod_base = OTHER; note = 2'-Fluoro-adenosine
  modified_base 10: mod_base = OTHER; note = 2'-Fluoro-uridine
  modified_base 11: mod_base = OTHER; note = 2'-Fluoro-guanosine
  modified_base 12: mod_base = OTHER; note = 2'-O-methyl-adenosine
  modified_base 13: mod_base = um
  modified_base 14: mod_base = gm
  modified_base 15: mod_base = OTHER; note = 2'-O-methyl-adenosine
  modified_base 16: mod_base = cm
  modified_base 17: mod_base = OTHER; note = 2'-O-methyl-adenosine
  modified_base 18: mod_base = um
  modified_base 19: mod_base = um
  modified_base 20: mod_base = um
  modified_base 21: mod_base = um
aggagaagatgatgacatttt

SEQ ID NO: 565 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = gm
  modified_base 4: mod_base = OTHER; note = 2'-O-methyl-adenosine
  modified_base 5: mod_base = gm
  modified_base 6: mod_base = gm
  modified_base 7: mod_base = OTHER; note = 2'-Fluoro-uridine
  modified_base 8: mod_base = gm
  modified_base 9: mod_base = OTHER; note = 2'-Fluoro-uridine
  modified_base 10: mod_base = OTHER; note = 2'-Fluoro-cytidine
  modified_base 11: mod_base = OTHER; note = 2'-Fluoro-uridine
  modified_base 12: mod_base = cm
  modified_base 13: mod_base = um
  modified_base 14: mod_base = gm
  modified_base 15: mod_base = cm
  modified_base 16: mod_base = um
  modified_base 17: mod_base = cm
  modified_base 18: mod_base = um
  modified_base 19: mod_base = OTHER; note = 2'-O-methyl-adenosine
  modified_base 20: mod_base = OTHER; note = 2'-O-methyl-adenosine
  modified_base 21: mod_base = gm
tggaggtgtctctgctctaag

SEQ ID NO: 566 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = um
  modified_base 6: mod_base = gm
  modified_base 7: mod_base = OTHER; note = 2'-Fluoro-guanosine
  modified_base 8: mod_base = gm
  modified_base 9: mod_base = OTHER; note = 2'-Fluoro-guanosine
  modified_base 10: mod_base = OTHER; note = 2'-Fluoro-cytidine
  modified_base 11: mod_base = OTHER; note = 2'-Fluoro-uridine
  modified_base 12: mod_base = gm
  modified_base 13: mod_base = gm
  modified_base 14: mod_base = gm
  modified_base 15: mod_base = gm
  modified_base 16: mod_base = OTHER; note = 2'-O-methyl-adenosine
  modified_base 17: mod_base = gm
  modified_base 18: mod_base = gm
  modified_base 19: mod_base = OTHER; note = 2'-O-methyl-adenosine
  modified_base 20: mod_base = gm
  modified_base 21: mod_base = OTHER; note = 2'-O-methyl-adenosine
ttattggggctggggaggaga

SEQ ID NO: 567 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = um
  modified_base 4: mod_base = gm
  modified_base 5: mod_base = OTHER; note = 2'-O-methyl-adenosine
  modified_base 6: mod_base = cm
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = OTHER; note = 2'-Fluoro-uridine
  modified_base 11: mod_base = OTHER; note = 2'-Fluoro-cytidine
  modified_base 12: mod_base = cm
  modified_base 13: mod_base = OTHER; note = 2'-O-methyl-adenosine
  modified_base 14: mod_base = OTHER; note = 2'-O-methyl-adenosine
  modified_base 15: mod_base = OTHER; note = 2'-O-methyl-adenosine
  modified_base 16: mod_base = gm
  modified_base 17: mod_base = um
  modified_base 18: mod_base = gm
  modified_base 19: mod_base = cm
  modified_base 20: mod_base = cm
  modified_base 21: mod_base = um
cctgacttttccaaagtgcct

SEQ ID NO: 568 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = cm
  modified_base 4: mod_base = OTHER; note = 2'-O-methyl-adenosine
  modified_base 5: mod_base = cm
  modified_base 6: mod_base = OTHER; note = 2'-O-methyl-adenosine
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = OTHER; note = 2'-Fluoro-cytidine
  modified_base 11: mod_base = OTHER; note = 2'-Fluoro-cytidine
  modified_base 12: mod_base = gm
  modified_base 13: mod_base = um
  modified_base 14: mod_base = um
  modified_base 15: mod_base = gm
  modified_base 16: mod_base = cm
  modified_base 17: mod_base = OTHER; note = 2'-O-methyl-adenosine
  modified_base 18: mod_base = OTHER; note = 2'-O-methyl-adenosine
  modified_base 19: mod_base = um
  modified_base 20: mod_base = gm
  modified_base 21: mod_base = gm
ggcacatttccgttgcaatgg

SEQ ID NO: 569 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = cm
  modified_base 4: mod_base = um
  modified_base 5: mod_base = cm
  modified_base 6: mod_base = um
  modified_base 7: mod_base = OTHER; note = 2'-Fluoro-adenosine
  modified_base 8: mod_base = OTHER; note = 2'-O-methyl-adenosine
  modified_base 9: mod_base = OTHER; note = 2'-Fluoro-guanosine
  modified_base 10: mod_base = OTHER; note = 2'-Fluoro-uridine
  modified_base 11: mod_base = OTHER; note = 2'-Fluoro-adenosine
  modified_base 12: mod_base = OTHER; note = 2'-O-methyl-adenosine
  modified_base 13: mod_base = OTHER; note = 2'-O-methyl-adenosine
  modified_base 14: mod_base = cm
  modified_base 15: mod_base = OTHER; note = 2'-O-methyl-adenosine
  modified_base 16: mod_base = OTHER; note = 2'-O-methyl-adenosine
  modified_base 17: mod_base = cm
  modified_base 18: mod_base = OTHER; note = 2'-O-methyl-adenosine
  modified_base 19: mod_base = gm
  modified_base 20: mod_base = um
  modified_base 21: mod_base = um
tgctctaagtaaacaacagtt

SEQ ID NO: 570 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = gm
  modified_base 4: mod_base = gm
  modified_base 5: mod_base = OTHER; note = 2'-O-methyl-adenosine
  modified_base 6: mod_base = gm
  modified_base 7: mod_base = OTHER; note = 2'-Fluoro-guanosine
  modified_base 8: mod_base = um
  modified_base 9: mod_base = OTHER; note = 2'-Fluoro-guanosine
  modified_base 10: mod_base = OTHER; note = 2'-Fluoro-uridine
  modified_base 11: mod_base = OTHER; note = 2'-Fluoro-cytidine
  modified_base 12: mod_base = um
  modified_base 13: mod_base = cm
  modified_base 14: mod_base = um
  modified_base 15: mod_base = gm
  modified_base 16: mod_base = cm
  modified_base 17: mod_base = um
  modified_base 18: mod_base = cm
  modified_base 19: mod_base = um
  modified_base 20: mod_base = OTHER; note = 2'-O-methyl-adenosine
  modified_base 21: mod_base = OTHER; note = 2'-O-methyl-adenosine
ttggaggtgtctctgctctaa

SEQ ID NO: 571 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = cm
  modified_base 4: mod_base = um
  modified_base 5: mod_base = OTHER; note = 2'-O-methyl-adenosine
  modified_base 6: mod_base = um
  modified_base 7: mod_base = OTHER; note = 2'-Fluoro-guanosine
  modified_base 8: mod_base = um
  modified_base 9: mod_base = OTHER; note = 2'-Fluoro-adenosine
  modified_base 10: mod_base = OTHER; note = 2'-Fluoro-adenosine
  modified_base 11: mod_base = OTHER; note = 2'-Fluoro-adenosine
  modified_base 12: mod_base = cm
  modified_base 13: mod_base = um
  modified_base 14: mod_base = um
  modified_base 15: mod_base = gm
  modified_base 16: mod_base = OTHER; note = 2'-O-methyl-adenosine
  modified_base 17: mod_base = OTHER; note = 2'-O-methyl-adenosine
  modified_base 18: mod_base = um
  modified_base 19: mod_base = um
  modified_base 20: mod_base = um
  modified_base 21: mod_base = cm
tgctatgtaaacttgaatttc

SEQ ID NO: 572 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = gm
  modified_base 4: mod_base = OTHER; note = 2'-O-methyl-adenosine
  modified_base 5: mod_base = um
  modified_base 6: mod_base = um
  modified_base 7: mod_base = OTHER; note = 2'-Fluoro-uridine
  modified_base 8: mod_base = cm
  modified_base 9: mod_base = OTHER; note = 2'-Fluoro-cytidine
  modified_base 10: mod_base = OTHER; note = 2'-Fluoro-uridine
  modified_base 11: mod_base = OTHER; note = 2'-Fluoro-adenosine
  modified_base 12: mod_base = OTHER; note = 2'-O-methyl-adenosine
  modified_base 13: mod_base = um
  modified_base 14: mod_base = OTHER; note = 2'-O-methyl-adenosine
  modified_base 15: mod_base = OTHER; note = 2'-O-methyl-adenosine
  modified_base 16: mod_base = um
  modified_base 17: mod_base = um
  modified_base 18: mod_base = OTHER; note = 2'-O-methyl-adenosine
  modified_base 19: mod_base = um
  modified_base 20: mod_base = um
  modified_base 21: mod_base = gm
tggatttcctaataattattg

SEQ ID NO: 573 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = OTHER; note = 2'-O-methyl-adenosine
  modified_base 5: mod_base = um
  modified_base 6: mod_base = um
  modified_base 7: mod_base = OTHER; note = 2'-Fluoro-guanosine
  modified_base 8: mod_base = gm
  modified_base 9: mod_base = OTHER; note = 2'-Fluoro-guanosine
  modified_base 10: mod_base = OTHER; note = 2'-Fluoro-guanosine
  modified_base 11: mod_base = OTHER; note = 2'-Fluoro-cytidine
  modified_base 12: mod_base = um
  modified_base 13: mod_base = gm
  modified_base 14: mod_base = gm
  modified_base 15: mod_base = gm
  modified_base 16: mod_base = gm
  modified_base 17: mod_base = OTHER; note = 2'-O-methyl-adenosine
  modified_base 18: mod_base = gm
  modified_base 19: mod_base = gm
  modified_base 20: mod_base = OTHER; note = 2'-O-methyl-adenosine
  modified_base 21: mod_base = gm
attattggggctggggaggag

SEQ ID NO: 574 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = um
  modified_base 5: mod_base = um
  modified_base 6: mod_base = cm
  modified_base 7: mod_base = OTHER; note = 2'-Fluoro-cytidine
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-adenosine
  modified_base 11: mod_base = OTHER; note = 2'-Fluoro-guanosine
  modified_base 12: mod_base = um
  modified_base 13: mod_base = gm
  modified_base 14: mod_base = cm
  modified_base 15: mod_base = cm
  modified_base 16: mod_base = um
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = OTHER; note = 2'-O-methyl-adenosine
cttttccaaagtgccttaaaa

SEQ ID NO: 575 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = um
  modified_base 4: mod_base = um
  modified_base 5: mod_base = gm
  modified_base 6: mod_base = gm
  modified_base 7: mod_base = OTHER; note = 2'-Fluoro-guanosine
  modified_base 8: mod_base = gm
  modified_base 9: mod_base = OTHER; note = 2'-Fluoro-cytidine
  modified_base 10: mod_base = OTHER; note = 2'-Fluoro-uridine
  modified_base 11: mod_base = OTHER; note = 2'-Fluoro-guanosine
  modified_base 12: mod_base = gm
  modified_base 13: mod_base = gm
  modified_base 14: mod_base = gm
  modified_base 15: mod_base = OTHER; note = 2'-O-methyl-adenosine
  modified_base 16: mod_base = gm
  modified_base 17: mod_base = gm
  modified_base 18: mod_base = OTHER; note = 2'-O-methyl-adenosine
  modified_base 19: mod_base = gm
  modified_base 20: mod_base = OTHER; note = 2'-O-methyl-adenosine
  modified_base 21: mod_base = OTHER; note = 2'-O-methyl-adenosine
tattggggctggggaggagaa

SEQ ID NO: 576 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = cm
  modified_base 4: mod_base = OTHER; note = 2'-O-methyl-adenosine
  modified_base 5: mod_base = um
  modified_base 6: mod_base = cm
  modified_base 7: mod_base = OTHER; note = 2'-Fluoro-guanosine
  modified_base 8: mod_base = gm
  modified_base 9: mod_base = OTHER; note = 2'-Fluoro-guanosine
  modified_base 10: mod_base = OTHER; note = 2'-Fluoro-adenosine
  modified_base 11: mod_base = OTHER; note = 2'-Fluoro-cytidine
  modified_base 12: mod_base = OTHER; note = 2'-O-methyl-adenosine
  modified_base 13: mod_base = cm
  modified_base 14: mod_base = cm
  modified_base 15: mod_base = gm
  modified_base 16: mod_base = OTHER; note = 2'-O-methyl-adenosine
  modified_base 17: mod_base = gm
  modified_base 18: mod_base = cm
  modified_base 19: mod_base = um
  modified_base 20: mod_base = OTHER; note = 2'-O-methyl-adenosine
  modified_base 21: mod_base = gm
gacatcgggacaccgagctag

SEQ ID NO: 577 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = cm
  modified_base 4: mod_base = OTHER; note = 2'-O-methyl-adenosine
  modified_base 5: mod_base = gm
  modified_base 6: mod_base = um
  modified_base 7: mod_base = OTHER; note = 2'-Fluoro-adenosine
  modified_base 8: mod_base = um
  modified_base 9: mod_base = OTHER; note = 2'-Fluoro-uridine
  modified_base 10: mod_base = OTHER; note = 2'-Fluoro-uridine
  modified_base 11: mod_base = OTHER; note = 2'-Fluoro-uridine
  modified_base 12: mod_base = gm
  modified_base 13: mod_base = gm
  modified_base 14: mod_base = OTHER; note = 2'-O-methyl-adenosine
  modified_base 15: mod_base = gm
  modified_base 16: mod_base = gm
  modified_base 17: mod_base = um
  modified_base 18: mod_base = gm
  modified_base 19: mod_base = um
  modified_base 20: mod_base = cm
  modified_base 21: mod_base = um
ttcagtattttggaggtgtct

SEQ ID NO: 578 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = gm
  modified_base 4: mod_base = gm
  modified_base 5: mod_base = um
  modified_base 6: mod_base = gm
  modified_base 7: mod_base = OTHER; note = 2'-Fluoro-uridine
  modified_base 8: mod_base = cm
  modified_base 9: mod_base = OTHER; note = 2'-Fluoro-uridine
  modified_base 10: mod_base = OTHER; note = 2'-Fluoro-cytidine
  modified_base 11: mod_base = OTHER; note = 2'-Fluoro-uridine
  modified_base 12: mod_base = gm
  modified_base 13: mod_base = cm
  modified_base 14: mod_base = um
  modified_base 15: mod_base = cm
  modified_base 16: mod_base = um
  modified_base 17: mod_base = OTHER; note = 2'-O-methyl-adenosine
  modified_base 18: mod_base = OTHER; note = 2'-O-methyl-adenosine
  modified_base 19: mod_base = gm
  modified_base 20: mod_base = um
  modified_base 21: mod_base = OTHER; note = 2'-O-methyl-adenosine
gaggtgtctctgctctaagta

SEQ ID NO: 579 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = gm
  modified_base 4: mod_base = um
  modified_base 5: mod_base = um
  modified_base 6: mod_base = um
  modified_base 7: mod_base = OTHER; note = 2'-Fluoro-guanosine
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-cytidine
  modified_base 11: mod_base = OTHER; note = 2'-Fluoro-uridine
  modified_base 12: mod_base = cm
  modified_base 13: mod_base = OTHER; note = 2'-O-methyl-adenosine
  modified_base 14: mod_base = cm
  modified_base 15: mod_base = um
  modified_base 16: mod_base = cm
  modified_base 17: mod_base = OTHER; note = 2'-O-methyl-adenosine
  modified_base 18: mod_base = cm
  modified_base 19: mod_base = cm
  modified_base 20: mod_base = um
  modified_base 21: mod_base = OTHER; note = 2'-O-methyl-adenosine
tggtttgaactcactcaccta

SEQ ID NO: 580 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = um
  modified_base 4: mod_base = gm
  modified_base 5: mod_base = OTHER; note = 2'-O-methyl-adenosine
  modified_base 6: mod_base = um
  modified_base 7: mod_base = OTHER; note = 2'-Fluoro-uridine
  modified_base 8: mod_base = um
  modified_base 9: mod_base = OTHER; note = 2'-Fluoro-cytidine
  modified_base 10: mod_base = OTHER; note = 2'-Fluoro-uridine
  modified_base 11: mod_base = OTHER; note = 2'-Fluoro-guanosine
  modified_base 12: mod_base = OTHER; note = 2'-O-methyl-adenosine
  modified_base 13: mod_base = OTHER; note = 2'-O-methyl-adenosine
  modified_base 14: mod_base = um
  modified_base 15: mod_base = gm
  modified_base 16: mod_base = um
  modified_base 17: mod_base = OTHER; note = 2'-O-methyl-adenosine
  modified_base 18: mod_base = OTHER; note = 2'-O-methyl-adenosine
  modified_base 19: mod_base = OTHER; note = 2'-O-methyl-adenosine
  modified_base 20: mod_base = gm
  modified_base 21: mod_base = um
tctgatttctgaatgtaaagt

SEQ ID NO: 581 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = um
  modified_base 4: mod_base = OTHER; note = 2'-O-methyl-adenosine
  modified_base 5: mod_base = OTHER; note = 2'-O-methyl-adenosine
  modified_base 6: mod_base = OTHER; note = 2'-O-methyl-adenosine
  modified_base 7: mod_base = OTHER; note = 2'-Fluoro-cytidine
  modified_base 8: mod_base = um
  modified_base 9: mod_base = OTHER; note = 2'-Fluoro-uridine
  modified_base 10: mod_base = OTHER; note = 2'-Fluoro-guanosine
  modified_base 11: mod_base = OTHER; note = 2'-Fluoro-adenosine
  modified_base 12: mod_base = OTHER; note = 2'-O-methyl-adenosine
  modified_base 13: mod_base = um
  modified_base 14: mod_base = um
  modified_base 15: mod_base = um
  modified_base 16: mod_base = cm
  modified_base 17: mod_base = cm
  modified_base 18: mod_base = um
  modified_base 19: mod_base = OTHER; note = 2'-O-methyl-adenosine
  modified_base 20: mod_base = um
  modified_base 21: mod_base = gm
tgtaaacttgaatttcctatg

SEQ ID NO: 582 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = gm
  modified_base 4: mod_base = um
  modified_base 5: mod_base = cm
  modified_base 6: mod_base = um
  modified_base 7: mod_base = OTHER; note = 2'-Fluoro-cytidine
  modified_base 8: mod_base = um
  modified_base 9: mod_base = OTHER; note = 2'-Fluoro-guanosine
  modified_base 10: mod_base = OTHER; note = 2'-Fluoro-cytidine
  modified_base 11: mod_base = OTHER; note = 2'-Fluoro-uridine
  modified_base 12: mod_base = cm
  modified_base 13: mod_base = um
  modified_base 14: mod_base = OTHER; note = 2'-O-methyl-adenosine
  modified_base 15: mod_base = OTHER; note = 2'-O-methyl-adenosine
  modified_base 16: mod_base = gm
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = cm
gtgtctctgctctaagtaaac

SEQ ID NO: 583 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = gm
  modified_base 4: mod_base = cm
  modified_base 5: mod_base = gm
  modified_base 6: mod_base = um
  modified_base 7: mod_base = OTHER; note = 2'-Fluoro-cytidine
  modified_base 8: mod_base = um
  modified_base 9: mod_base = OTHER; note = 2'-Fluoro-cytidine
  modified_base 10: mod_base = OTHER; note = 2'-Fluoro-uridine
  modified_base 11: mod_base = OTHER; note = 2'-Fluoro-cytidine
  modified_base 12: mod_base = cm
  modified_base 13: mod_base = um
  modified_base 14: mod_base = cm
  modified_base 15: mod_base = OTHER; note = 2'-O-methyl-adenosine
  modified_base 16: mod_base = cm
  modified_base 17: mod_base = OTHER; note = 2'-O-methyl-adenosine
  modified_base 18: mod_base = OTHER; note = 2'-O-methyl-adenosine
  modified_base 19: mod_base = gm
  modified_base 20: mod_base = gm
  modified_base 21: mod_base = um
ctgcgtctctcctcacaaggt

SEQ ID NO: 584 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = gm
  modified_base 6: mod_base = um
  modified_base 7: mod_base = OTHER; note = 2'-Fluoro-uridine
  modified_base 8: mod_base = cm
  modified_base 9: mod_base = OTHER; note = 2'-Fluoro-adenosine
  modified_base 10: mod_base = OTHER; note = 2'-Fluoro-guanosine
  modified_base 11: mod_base = OTHER; note = 2'-Fluoro-uridine
  modified_base 12: mod_base = OTHER; note = 2'-O-methyl-adenosine
  modified_base 13: mod_base = um
  modified_base 14: mod_base = um
  modified_base 15: mod_base = um
  modified_base 16: mod_base = um
  modified_base 17: mod_base = gm
  modified_base 18: mod_base = gm
  modified_base 19: mod_base = OTHER; note = 2'-O-methyl-adenosine
  modified_base 20: mod_base = gm
  modified_base 21: mod_base = gm
ttatgttcagtattttggagg

SEQ ID NO: 585 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = cm
  modified_base 4: mod_base = OTHER; note = 2'-O-methyl-adenosine
  modified_base 5: mod_base = gm
  modified_base 6: mod_base = um
  modified_base 7: mod_base = OTHER; note = 2'-Fluoro-guanosine
  modified_base 8: mod_base = gm
  modified_base 9: mod_base = OTHER; note = 2'-Fluoro-adenosine
  modified_base 10: mod_base = OTHER; note = 2'-Fluoro-cytidine
  modified_base 11: mod_base = OTHER; note = 2'-Fluoro-adenosine
  modified_base 12: mod_base = um
  modified_base 13: mod_base = cm
  modified_base 14: mod_base = gm
  modified_base 15: mod_base = gm
  modified_base 16: mod_base = gm
  modified_base 17: mod_base = OTHER; note = 2'-O-methyl-adenosine
  modified_base 18: mod_base = cm
  modified_base 19: mod_base = OTHER; note = 2'-O-methyl-adenosine
  modified_base 20: mod_base = cm
  modified_base 21: mod_base = cm
cacagtggacatcgggacacc

SEQ ID NO: 586 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = um
  modified_base 4: mod_base = gm
  modified_base 5: mod_base = cm
  modified_base 6: mod_base = um
  modified_base 7: mod_base = OTHER; note = 2'-Fluoro-cytidine
  modified_base 8: mod_base = um
  modified_base 9: mod_base = OTHER; note = 2'-Fluoro-adenosine
  modified_base 10: mod_base = OTHER; note = 2'-Fluoro-adenosine
  modified_base 11: mod_base = OTHER; note = 2'-Fluoro-guanosine
  modified_base 12: mod_base = um
  modified_base 13: mod_base = OTHER; note = 2'-O-methyl-adenosine
  modified_base 14: mod_base = OTHER; note = 2'-O-methyl-adenosine
  modified_base 15: mod_base = OTHER; note = 2'-O-methyl-adenosine
  modified_base 16: mod_base = cm
  modified_base 17: mod_base = OTHER; note = 2'-O-methyl-adenosine
  modified_base 18: mod_base = OTHER; note = 2'-O-methyl-adenosine
  modified_base 19: mod_base = cm
  modified_base 20: mod_base = OTHER; note = 2'-O-methyl-adenosine
  modified_base 21: mod_base = gm
tctgctctaagtaaacaacag

SEQ ID NO: 587 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = gm
  modified_base 4: mod_base = cm
  modified_base 5: mod_base = OTHER; note = 2'-O-methyl-adenosine
  modified_base 6: mod_base = cm
  modified_base 7: mod_base = OTHER; note = 2'-Fluoro-adenosine
  modified_base 8: mod_base = um
  modified_base 9: mod_base = OTHER; note = 2'-Fluoro-uridine
  modified_base 10: mod_base = OTHER; note = 2'-Fluoro-uridine
  modified_base 11: mod_base = OTHER; note = 2'-Fluoro-cytidine
  modified_base 12: mod_base = cm
  modified_base 13: mod_base = gm
  modified_base 14: mod_base = um
  modified_base 15: mod_base = um
  modified_base 16: mod_base = gm
  modified_base 17: mod_base = cm
  modified_base 18: mod_base = OTHER; note = 2'-O-methyl-adenosine
  modified_base 19: mod_base = OTHER; note = 2'-O-methyl-adenosine
  modified_base 20: mod_base = um
  modified_base 21: mod_base = gm
cggcacatttccgttgcaatg

SEQ ID NO: 588 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = OTHER; note = 2'-O-methyl-adenosine
  modified_base 4: mod_base = gm
  modified_base 5: mod_base = um
  modified_base 6: mod_base = OTHER; note = 2'-O-methyl-adenosine
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = OTHER; note = 2'-Fluoro-uridine
  modified_base 11: mod_base = OTHER; note = 2'-Fluoro-guanosine
  modified_base 12: mod_base = gm
  modified_base 13: mod_base = OTHER; note = 2'-O-methyl-adenosine
  modified_base 14: mod_base = gm
  modified_base 15: mod_base = gm
  modified_base 16: mod_base = um
  modified_base 17: mod_base = gm
  modified_base 18: mod_base = um
  modified_base 19: mod_base = cm
  modified_base 20: mod_base = um
  modified_base 21: mod_base = cm
tcagtattttggaggtgtctc

SEQ ID NO: 589 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = OTHER; note = 2'-O-methyl-adenosine
  modified_base 6: mod_base = um
  modified_base 7: mod_base = OTHER; note = 2'-Fluoro-uridine
  modified_base 8: mod_base = um
  modified_base 9: mod_base = OTHER; note = 2'-Fluoro-cytidine
  modified_base 10: mod_base = OTHER; note = 2'-Fluoro-cytidine
  modified_base 11: mod_base = OTHER; note = 2'-Fluoro-guanosine
  modified_base 12: mod_base = um
  modified_base 13: mod_base = um
  modified_base 14: mod_base = gm
  modified_base 15: mod_base = cm
  modified_base 16: mod_base = OTHER; note = 2'-O-methyl-adenosine
  modified_base 17: mod_base = OTHER; note = 2'-O-methyl-adenosine
  modified_base 18: mod_base = um
  modified_base 19: mod_base = gm
  modified_base 20: mod_base = gm
  modified_base 21: mod_base = OTHER; note = 2'-O-methyl-adenosine
gcacatttccgttgcaatgga

SEQ ID NO: 590 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = um
  modified_base 4: mod_base = gm
  modified_base 5: mod_base = cm
  modified_base 6: mod_base = um
  modified_base 7: mod_base = OTHER; note = 2'-Fluoro-adenosine
  modified_base 8: mod_base = um
  modified_base 9: mod_base = OTHER; note = 2'-Fluoro-guanosine
  modified_base 10: mod_base = OTHER; note = 2'-Fluoro-uridine
  modified_base 11: mod_base = OTHER; note = 2'-Fluoro-adenosine
  modified_base 12: mod_base = OTHER; note = 2'-O-methyl-adenosine
  modified_base 13: mod_base = OTHER; note = 2'-O-methyl-adenosine
  modified_base 14: mod_base = cm
  modified_base 15: mod_base = um
  modified_base 16: mod_base = um
  modified_base 17: mod_base = gm
  modified_base 18: mod_base = OTHER; note = 2'-O-methyl-adenosine
  modified_base 19: mod_base = OTHER; note = 2'-O-methyl-adenosine
  modified_base 20: mod_base = um
  modified_base 21: mod_base = um
catgctatgtaaacttgaatt

SEQ ID NO: 591 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = cm
  modified_base 4: mod_base = cm
  modified_base 5: mod_base = um
  modified_base 6: mod_base = cm
  modified_base 7: mod_base = OTHER; note = 2'-Fluoro-adenosine
  modified_base 8: mod_base = gm
  modified_base 9: mod_base = OTHER; note = 2'-Fluoro-adenosine
  modified_base 10: mod_base = OTHER; note = 2'-Fluoro-guanosine
  modified_base 11: mod_base = OTHER; note = 2'-Fluoro-guanosine
  modified_base 12: mod_base = um
  modified_base 13: mod_base = um
  modified_base 14: mod_base = um
  modified_base 15: mod_base = gm
  modified_base 16: mod_base = OTHER; note = 2'-O-methyl-adenosine
  modified_base 17: mod_base = cm
  modified_base 18: mod_base = cm
  modified_base 19: mod_base = gm
  modified_base 20: mod_base = OTHER; note = 2'-O-methyl-adenosine
  modified_base 21: mod_base = OTHER; note = 2'-O-methyl-adenosine
atcctcagaggtttgaccgaa

SEQ ID NO: 592 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = OTHER; note = 2'-O-methyl-adenosine
  modified_base 6: mod_base = gm
  modified_base 7: mod_base = OTHER; note = 2'-Fluoro-uridine
  modified_base 8: mod_base = gm
  modified_base 9: mod_base = OTHER; note = 2'-Fluoro-guanosine
  modified_base 10: mod_base = OTHER; note = 2'-Fluoro-adenosine
  modified_base 11: mod_base = OTHER; note = 2'-Fluoro-cytidine
  modified_base 12: mod_base = OTHER; note = 2'-O-methyl-adenosine
  modified_base 13: mod_base = um
  modified_base 14: mod_base = cm
  modified_base 15: mod_base = gm
  modified_base 16: mod_base = gm
  modified_base 17: mod_base = gm
  modified_base 18: mod_base = OTHER; note = 2'-O-methyl-adenosine
  modified_base 19: mod_base = cm
  modified_base 20: mod_base = OTHER; note = 2'-O-methyl-adenosine
  modified_base 21: mod_base = cm
tcacagtggacatcgggacac

SEQ ID NO: 593 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = um
  modified_base 5: mod_base = cm
  modified_base 6: mod_base = OTHER; note = 2'-O-methyl-adenosine
  modified_base 7: mod_base = OTHER; note = 2'-Fluoro-adenosine
  modified_base 8: mod_base = gm
  modified_base 9: mod_base = OTHER; note = 2'-Fluoro-adenosine
  modified_base 10: mod_base = OTHER; note = 2'-Fluoro-adenosine
  modified_base 11: mod_base = OTHER; note = 2'-Fluoro-guanosine
  modified_base 12: mod_base = cm
  modified_base 13: mod_base = cm
  modified_base 14: mod_base = um
  modified_base 15: mod_base = um
  modified_base 16: mod_base = gm
  modified_base 17: mod_base = OTHER; note = 2'-O-methyl-adenosine
  modified_base 18: mod_base = OTHER; note = 2'-O-methyl-adenosine
  modified_base 19: mod_base = gm
  modified_base 20: mod_base = gm
  modified_base 21: mod_base = OTHER; note = 2'-O-methyl-adenosine
ctttcaagaagccttgaagga

SEQ ID NO: 594 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = gm
  modified_base 4: mod_base = um
  modified_base 5: mod_base = gm
  modified_base 6: mod_base = um
  modified_base 7: mod_base = OTHER; note = 2'-Fluoro-cytidine
  modified_base 8: mod_base = um
  modified_base 9: mod_base = OTHER; note = 2'-Fluoro-cytidine
  modified_base 10: mod_base = OTHER; note = 2'-Fluoro-uridine
  modified_base 11: mod_base = OTHER; note = 2'-Fluoro-guanosine
  modified_base 12: mod_base = cm
  modified_base 13: mod_base = um
  modified_base 14: mod_base = cm
  modified_base 15: mod_base = um
  modified_base 16: mod_base = OTHER; note = 2'-O-methyl-adenosine
  modified_base 17: mod_base = OTHER; note = 2'-O-methyl-adenosine
  modified_base 18: mod_base = gm
  modified_base 19: mod_base = um
  modified_base 20: mod_base = OTHER; note = 2'-O-methyl-adenosine
  modified_base 21: mod_base = OTHER; note = 2'-O-methyl-adenosine
aggtgtctctgctctaagtaa

SEQ ID NO: 595 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = um
  modified_base 5: mod_base = gm
  modified_base 6: mod_base = gm
  modified_base 7: mod_base = OTHER; note = 2'-Fluoro-adenosine
  modified_base 8: mod_base = gm
  modified_base 9: mod_base = OTHER; note = 2'-Fluoro-guanosine
  modified_base 10: mod_base = OTHER; note = 2'-Fluoro-uridine
  modified_base 11: mod_base = OTHER; note = 2'-Fluoro-guanosine
  modified_base 12: mod_base = um
  modified_base 13: mod_base = cm
  modified_base 14: mod_base = um
  modified_base 15: mod_base = cm
  modified_base 16: mod_base = um
  modified_base 17: mod_base = gm
  modified_base 18: mod_base = cm
  modified_base 19: mod_base = um
  modified_base 20: mod_base = cm
  modified_base 21: mod_base = um
ttttggaggtgtctctgctct

SEQ ID NO: 596 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = gm
  modified_base 6: mod_base = OTHER; note = 2'-O-methyl-adenosine
  modified_base 7: mod_base = OTHER; note = 2'-Fluoro-adenosine
  modified_base 8: mod_base = um
  modified_base 9: mod_base = OTHER; note = 2'-Fluoro-guanosine
  modified_base 10: mod_base = OTHER; note = 2'-Fluoro-uridine
  modified_base 11: mod_base = OTHER; note = 2'-Fluoro-guanosine
  modified_base 12: mod_base = cm
  modified_base 13: mod_base = cm
  modified_base 14: mod_base = um
  modified_base 15: mod_base = um
  modified_base 16: mod_base = um
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20: mod_base = um
  modified_base 21: mod_base = um
gcatgaatgtgccttttaatt

SEQ ID NO: 597 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = cm
  modified_base 6: mod_base = gm
  modified_base 7: mod_base = OTHER; note = 2'-Fluoro-guanosine
  modified_base 8: mod_base = gm
  modified_base 9: mod_base = OTHER; note = 2'-Fluoro-adenosine
  modified_base 10: mod_base = OTHER; note = 2'-Fluoro-cytidine
  modified_base 11: mod_base = OTHER; note = 2'-Fluoro-adenosine
  modified_base 12: mod_base = cm
  modified_base 13: mod_base = cm
  modified_base 14: mod_base = gm
  modified_base 15: mod_base = OTHER; note = 2'-O-methyl-adenosine
  modified_base 16: mod_base = gm
  modified_base 17: mod_base = cm
  modified_base 18: mod_base = um
  modified_base 19: mod_base = OTHER; note = 2'-O-methyl-adenosine
  modified_base 20: mod_base = gm
  modified_base 21: mod_base = cm
acatcgggacaccgagctagc

SEQ ID NO: 598 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = um
  modified_base 4: mod_base = gm
  modified_base 5: mod_base = cm
  modified_base 6: mod_base = gm
  modified_base 7: mod_base = OTHER; note = 2'-Fluoro-uridine
  modified_base 8: mod_base = cm
  modified_base 9: mod_base = OTHER; note = 2'-Fluoro-uridine
  modified_base 10: mod_base = OTHER; note = 2'-Fluoro-cytidine
  modified_base 11: mod_base = OTHER; note = 2'-Fluoro-uridine
  modified_base 12: mod_base = cm
  modified_base 13: mod_base = cm
  modified_base 14: mod_base = um
  modified_base 15: mod_base = cm
  modified_base 16: mod_base = OTHER; note = 2'-O-methyl-adenosine
  modified_base 17: mod_base = cm
  modified_base 18: mod_base = OTHER; note = 2'-O-methyl-adenosine
  modified_base 19: mod_base = OTHER; note = 2'-O-methyl-adenosine
  modified_base 20: mod_base = gm
  modified_base 21: mod_base = gm
actgcgtctctcctcacaagg

SEQ ID NO: 599 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = OTHER; note = 2'-O-methyl-adenosine
  modified_base 4: mod_base = um
  modified_base 5: mod_base = OTHER; note = 2'-O-methyl-adenosine
  modified_base 6: mod_base = cm
  modified_base 7: mod_base = OTHER; note = 2'-Fluoro-cytidine
  modified_base 8: mod_base = cm
  modified_base 9: mod_base = OTHER; note = 2'-Fluoro-adenosine
  modified_base 10: mod_base = OTHER; note = 2'-Fluoro-adenosine
  modified_base 11: mod_base = OTHER; note = 2'-Fluoro-adenosine
  modified_base 12: mod_base = um
  modified_base 13: mod_base = cm
  modified_base 14: mod_base = OTHER; note = 2'-O-methyl-adenosine
  modified_base 15: mod_base = cm
  modified_base 16: mod_base = OTHER; note = 2'-O-methyl-adenosine
  modified_base 17: mod_base = gm
  modified_base 18: mod_base = um
  modified_base 19: mod_base = gm
  modified_base 20: mod_base = gm
  modified_base 21: mod_base = OTHER; note = 2'-O-methyl-adenosine
gtatacccaaatcacagtgga

SEQ ID NO: 600 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = cm
  modified_base 4: mod_base = um
  modified_base 5: mod_base = gm
  modified_base 6: mod_base = gm
  modified_base 7: mod_base = OTHER; note = 2'-Fluoro-adenosine
  modified_base 8: mod_base = um
  modified_base 9: mod_base = OTHER; note = 2'-Fluoro-guanosine
  modified_base 10: mod_base = OTHER; note = 2'-Fluoro-uridine
  modified_base 11: mod_base = OTHER; note = 2'-Fluoro-adenosine
  modified_base 12: mod_base = cm
  modified_base 13: mod_base = OTHER; note = 2'-O-methyl-adenosine
  modified_base 14: mod_base = gm
  modified_base 15: mod_base = OTHER; note = 2'-O-methyl-adenosine
  modified_base 16: mod_base = gm
  modified_base 17: mod_base = OTHER; note = 2'-O-methyl-adenosine
  modified_base 18: mod_base = um
  modified_base 19: mod_base = OTHER; note = 2'-O-methyl-adenosine
  modified_base 20: mod_base = cm
  modified_base 21: mod_base = cm
tgctggatgtacagagatacc

SEQ ID NO: 601 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = gm
  modified_base 4: mod_base = um
  modified_base 5: mod_base = OTHER; note = 2'-O-methyl-adenosine
  modified_base 6: mod_base = OTHER; note = 2'-O-methyl-adenosine
  modified_base 7: mod_base = OTHER; note = 2'-Fluoro-adenosine
  modified_base 8: mod_base = cm
  modified_base 9: mod_base = OTHER; note = 2'-Fluoro-uridine
  modified_base 10: mod_base = OTHER; note = 2'-Fluoro-uridine
  modified_base 11: mod_base = OTHER; note = 2'-Fluoro-guanosine
  modified_base 12: mod_base = OTHER; note = 2'-O-methyl-adenosine
  modified_base 13: mod_base = OTHER; note = 2'-O-methyl-adenosine
  modified_base 14: mod_base = um
  modified_base 15: mod_base = um
  modified_base 16: mod_base = um
  modified_base 17: mod_base = cm
  modified_base 18: mod_base = cm
  modified_base 19: mod_base = um
  modified_base 20: mod_base = OTHER; note = 2'-O-methyl-adenosine
  modified_base 21: mod_base = um
atgtaaacttgaatttcctat

SEQ ID NO: 602 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = gm
  modified_base 4: mod_base = gm
  modified_base 5: mod_base = cm
  modified_base 6: mod_base = um
  modified_base 7: mod_base = OTHER; note = 2'-Fluoro-guanosine
  modified_base 8: mod_base = gm
  modified_base 9: mod_base = OTHER; note = 2'-Fluoro-guanosine
  modified_base 10: mod_base = OTHER; note = 2'-Fluoro-guanosine
  modified_base 11: mod_base = OTHER; note = 2'-Fluoro-adenosine
  modified_base 12: mod_base = gm
  modified_base 13: mod_base = gm
  modified_base 14: mod_base = OTHER; note = 2'-O-methyl-adenosine
  modified_base 15: mod_base = gm
  modified_base 16: mod_base = OTHER; note = 2'-O-methyl-adenosine
  modified_base 17: mod_base = OTHER; note = 2'-O-methyl-adenosine
  modified_base 18: mod_base = gm
  modified_base 19: mod_base = OTHER; note = 2'-O-methyl-adenosine
  modified_base 20: mod_base = um
  modified_base 21: mod_base = gm
ggggctggggaggagaagatg

SEQ ID NO: 603 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = cm
  modified_base 4: mod_base = um
  modified_base 5: mod_base = gm
  modified_base 6: mod_base = cm
  modified_base 7: mod_base = OTHER; note = 2'-Fluoro-uridine
  modified_base 8: mod_base = cm
  modified_base 9: mod_base = OTHER; note = 2'-Fluoro-uridine
  modified_base 10: mod_base = OTHER; note = 2'-Fluoro-adenosine
  modified_base 11: mod_base = OTHER; note = 2'-Fluoro-adenosine
  modified_base 12: mod_base = gm
  modified_base 13: mod_base = um
  modified_base 14: mod_base = OTHER; note = 2'-O-methyl-adenosine
  modified_base 15: mod_base = OTHER; note = 2'-O-methyl-adenosine
  modified_base 16: mod_base = OTHER; note = 2'-O-methyl-adenosine
  modified_base 17: mod_base = cm
  modified_base 18: mod_base = OTHER; note = 2'-O-methyl-adenosine
  modified_base 19: mod_base = OTHER; note = 2'-O-methyl-adenosine
  modified_base 20: mod_base = cm
  modified_base 21: mod_base = OTHER; note = 2'-O-methyl-adenosine
ctctgctctaagtaaacaaca

SEQ ID NO: 604 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = gm
  modified_base 4: mod_base = gm
  modified_base 5: mod_base = gm
  modified_base 6: mod_base = cm
  modified_base 7: mod_base = OTHER; note = 2'-Fluoro-uridine
  modified_base 8: mod_base = gm
  modified_base 9: mod_base = OTHER; note = 2'-Fluoro-guanosine
  modified_base 10: mod_base = OTHER; note = 2'-Fluoro-guanosine
  modified_base 11: mod_base = OTHER; note = 2'-Fluoro-guanosine
  modified_base 12: mod_base = OTHER; note = 2'-O-methyl-adenosine
  modified_base 13: mod_base = gm
  modified_base 14: mod_base = gm
  modified_base 15: mod_base = OTHER; note = 2'-O-methyl-adenosine
  modified_base 16: mod_base = gm
  modified_base 17: mod_base = OTHER; note = 2'-O-methyl-adenosine
  modified_base 18: mod_base = OTHER; note = 2'-O-methyl-adenosine
  modified_base 19: mod_base = gm
  modified_base 20: mod_base = OTHER; note = 2'-O-methyl-adenosine
  modified_base 21: mod_base = um
tggggctggggaggagaagat

SEQ ID NO: 605 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = um
  modified_base 4: mod_base = cm
  modified_base 5: mod_base = OTHER; note = 2'-O-methyl-adenosine
  modified_base 6: mod_base = cm
  modified_base 7: mod_base = OTHER; note = 2'-Fluoro-adenosine
  modified_base 8: mod_base = gm
  modified_base 9: mod_base = OTHER; note = 2'-Fluoro-uridine
  modified_base 10: mod_base = OTHER; note = 2'-Fluoro-guanosine
  modified_base 11: mod_base = OTHER; note = 2'-Fluoro-guanosine
  modified_base 12: mod_base = OTHER; note = 2'-O-methyl-adenosine
  modified_base 13: mod_base = cm
  modified_base 14: mod_base = OTHER; note = 2'-O-methyl-adenosine
  modified_base 15: mod_base = um
  modified_base 16: mod_base = cm
  modified_base 17: mod_base = gm
  modified_base 18: mod_base = gm
  modified_base 19: mod_base = gm
  modified_base 20: mod_base = OTHER; note = 2'-O-methyl-adenosine
  modified_base 21: mod_base = cm
aatcacagtggacatcgggac

SEQ ID NO: 606 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = gm
  modified_base 2^3: mod_base = OTHER; note = Phosphorothioate bond
  modified_base 3: mod_base = um
  modified_base 4: mod_base = gm
  modified_base 5: mod_base = gm
  modified_base 6: mod_base = OTHER; note = 2'-O-methyl-adenosine
  modified_base 7: mod_base = OTHER; note = 2'-Fluoro-cytidine
  modified_base 8: mod_base = OTHER; note = 2'-O-methyl-adenosine
  modified_base 9: mod_base = OTHER; note = 2'-Fluoro-uridine
  modified_base 10: mod_base = OTHER; note = 2'-Fluoro-cytidine
  modified_base 11: mod_base = OTHER; note = 2'-Fluoro-guanosine
  modified_base 12: mod_base = gm
  modified_base 13: mod_base = gm
  modified_base 14: mod_base = OTHER; note = 2'-O-methyl-adenosine
  modified_base 15: mod_base = cm
  modified_base 16: mod_base = OTHER; note = 2'-O-methyl-adenosine
  modified_base 17: mod_base = cm
  modified_base 18: mod_base = cm
  modified_base 19: mod_base = gm
  modified_base 20: mod_base = OTHER; note = 2'-O-methyl-adenosine
  modified_base 21: mod_base = gm
agtggacatcgggacaccgag

SEQ ID NO: 607 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = um
  modified_base 4: mod_base = OTHER; note = 2'-O-methyl-adenosine
  modified_base 5: mod_base = OTHER; note = 2'-O-methyl-adenosine
  modified_base 6: mod_base = um
  modified_base 7: mod_base = OTHER; note = 2'-Fluoro-uridine
  modified_base 8: mod_base = OTHER; note = 2'-O-methyl-adenosine
  modified_base 9: mod_base = OTHER; note = 2'-Fluoro-uridine
  modified_base 10: mod_base = OTHER; note = 2'-Fluoro-uridine
  modified_base 11: mod_base = OTHER; note = 2'-Fluoro-guanosine
  modified_base 12: mod_base = gm
  modified_base 13: mod_base = gm
  modified_base 14: mod_base = gm
  modified_base 15: mod_base = cm
  modified_base 16: mod_base = um
  modified_base 17: mod_base = gm
  modified_base 18: mod_base = gm
  modified_base 19: mod_base = gm
  modified_base 20: mod_base = gm
  modified_base 21: mod_base = OTHER; note = 2'-O-methyl-adenosine
aataattattggggctgggga

SEQ ID NO: 608 - RNA, 21 nt, synthetic construct
  source 1..21: mol_type = other RNA
  modified_base 1: mod_base = cm
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = gm
  modified_base 4: mod_base = um
  modified_base 5: mod_base = OTHER; note = 2'-O-methyl-adenosine
  modified_base 6: mod_base = um
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = OTHER; note = 2'-Fluoro-guanosine
  modified_base 11: mod_base = OTHER; note = 2'-Fluoro-guanosine
  modified_base 12: mod_base = OTHER; note = 2'-O-methyl-adenosine
  modified_base 13: mod_base = gm
  modified_base 14: mod_base = gm
  modified_base 15: mod_base = um
  modified_base 16: mod_base = gm
  modified_base 17: mod_base = um
  modified_base 18: mod_base = cm
  modified_base 19: mod_base = um
  modified_base 20: mod_base = cm
  modified_base 21: mod_base = um
cagtattttggaggtgtctct

SEQ ID NO: 609 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = um
  modified_base 5: mod_base = um
  modified_base 6: mod_base = gm
  modified_base 7: mod_base = OTHER; note = 2'-Fluoro-guanosine
  modified_base 8: mod_base = OTHER; note = 2'-O-methyl-adenosine
  modified_base 9: mod_base = OTHER; note = 2'-Fluoro-guanosine
  modified_base 10: mod_base = OTHER; note = 2'-Fluoro-guanosine
  modified_base 11: mod_base = OTHER; note = 2'-Fluoro-uridine
  modified_base 12: mod_base = gm
  modified_base 13: mod_base = um
  modified_base 14: mod_base = cm
  modified_base 15: mod_base = um
  modified_base 16: mod_base = cm
  modified_base 17: mod_base = um
  modified_base 18: mod_base = gm
  modified_base 19: mod_base = cm
  modified_base 20: mod_base = um
  modified_base 21: mod_base = cm
attttggaggtgtctctgctc

SEQ ID NO: 610 - RNA, 21 nt, synthetic construct
  source 1..21: mol_type = other RNA
  modified_base <1: mod_base = OTHER; note = two inverted abasic nucleosides
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = um
  modified_base 6: mod_base = um
  modified_base 7: mod_base = OTHER; note = 2'-Fluoro-guanosine
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-uridine
  modified_base 11: mod_base = OTHER; note = 2'-Fluoro-uridine
  modified_base 12: mod_base = OTHER; note = 2'-Fluoro-uridine
  modified_base 13: mod_base = cm
  modified_base 14: mod_base = cm
  modified_base 15: mod_base = um
  modified_base 16: mod_base = OTHER; note = 2'-O-methyl-adenosine
  modified_base 17: mod_base = um
  modified_base 18: mod_base = gm
  modified_base 19: mod_base = um
  modified_base 20: mod_base = OTHER; note = 2'-O-methyl-adenosine
  modified_base 21: mod_base = um
aaacttgaatttcctatgtat

SEQ ID NO: 611 - RNA, 21 nt, synthetic construct
  source 1..21: mol_type = other RNA
  modified_base <1: mod_base = OTHER; note = two inverted abasic nucleosides
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = OTHER; note = 2'-O-methyl-adenosine
  modified_base 4: mod_base = cm
  modified_base 5: mod_base = um
  modified_base 6: mod_base = um
  modified_base 7: mod_base = gm
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-uridine
  modified_base 11: mod_base = OTHER; note = 2'-Fluoro-uridine
  modified_base 12: mod_base = um
  modified_base 13: mod_base = cm
  modified_base 14: mod_base = cm
  modified_base 15: mod_base = um
  modified_base 16: mod_base = OTHER; note = 2'-O-methyl-adenosine
  modified_base 17: mod_base = um
  modified_base 18: mod_base = gm
  modified_base 19: mod_base = um
  modified_base 20: mod_base = OTHER; note = 2'-O-methyl-adenosine
  modified_base 21: mod_base = um
aaacttgaatttcctatgtat

SEQ ID NO: 612 - RNA, 21 nt, synthetic construct
  source 1..21: mol_type = other RNA
  modified_base <1: mod_base = OTHER; note = two inverted abasic nucleosides
  modified_base 1: mod_base = cm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = gm
  modified_base 5: mod_base = OTHER; note = 2'-O-methyl-adenosine
  modified_base 6: mod_base = OTHER; note = 2'-O-methyl-adenosine
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = OTHER; note = 2'-Fluoro-cytidine
  modified_base 11: mod_base = OTHER; note = 2'-Fluoro-cytidine
  modified_base 12: mod_base = OTHER; note = 2'-Fluoro-uridine
  modified_base 13: mod_base = OTHER; note = 2'-O-methyl-adenosine
  modified_base 14: mod_base = um
  modified_base 15: mod_base = gm
  modified_base 16: mod_base = um
  modified_base 17: mod_base = OTHER; note = 2'-O-methyl-adenosine
  modified_base 18: mod_base = um
  modified_base 19: mod_base = um
  modified_base 20: mod_base = um
  modified_base 21: mod_base = um
cttgaatttcctatgtatttt

SEQ ID NO: 613 - RNA, 21 nt, synthetic construct
  source 1..21: mol_type = other RNA
  modified_base <1: mod_base = OTHER; note = two inverted abasic nucleosides
  modified_base 1: mod_base = cm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = gm
  modified_base 5: mod_base = OTHER; note = 2'-O-methyl-adenosine
  modified_base 6: mod_base = OTHER; note = 2'-O-methyl-adenosine
  modified_base 7: mod_base = um
  modified_base 8: mod_base = um
  modified_base 9: mod_base = OTHER; note = 2'-Fluoro-uridine
  modified_base 10: mod_base = OTHER; note = 2'-Fluoro-cytidine
  modified_base 11: mod_base = OTHER; note = 2'-Fluoro-cytidine
  modified_base 12: mod_base = um
  modified_base 13: mod_base = OTHER; note = 2'-O-methyl-adenosine
  modified_base 14: mod_base = um
  modified_base 15: mod_base = gm
  modified_base 16: mod_base = um
  modified_base 17: mod_base = OTHER; note = 2'-O-methyl-adenosine
  modified_base 18: mod_base = um
  modified_base 19: mod_base = um
  modified_base 20: mod_base = um
  modified_base 21: mod_base = um
cttgaatttcctatgtatttt

SEQ ID NO: 614 - RNA, 21 nt, synthetic construct
  source 1..21: mol_type = other RNA
  modified_base <1: mod_base = OTHER; note = two inverted abasic nucleosides
  modified_base 1: mod_base = cm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = um
  modified_base 5: mod_base = um
  modified_base 6: mod_base = cm
  modified_base 7: mod_base = OTHER; note = 2'-Fluoro-cytidine
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-adenosine
  modified_base 11: mod_base = OTHER; note = 2'-Fluoro-guanosine
  modified_base 12: mod_base = OTHER; note = 2'-Fluoro-uridine
  modified_base 13: mod_base = gm
  modified_base 14: mod_base = cm
  modified_base 15: mod_base = cm
  modified_base 16: mod_base = um
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = OTHER; note = 2'-O-methyl-adenosine
cttttccaaagtgccttaaaa

SEQ ID NO: 615 - RNA, 21 nt, synthetic construct
  source 1..21: mol_type = other RNA
  modified_base <1: mod_base = OTHER; note = two inverted abasic nucleosides
  modified_base 1: mod_base = cm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = um
  modified_base 5: mod_base = um
  modified_base 6: mod_base = cm
  modified_base 7: mod_base = cm
  modified_base 8: mod_base = OTHER; note = 2'-O-methyl-adenosine
  modified_base 9: mod_base = OTHER; note = 2'-Fluoro-adenosine
  modified_base 10: mod_base = OTHER; note = 2'-Fluoro-adenosine
  modified_base 11: mod_base = OTHER; note = 2'-Fluoro-guanosine
  modified_base 12: mod_base = um
  modified_base 13: mod_base = gm
  modified_base 14: mod_base = cm
  modified_base 15: mod_base = cm
  modified_base 16: mod_base = um
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20: mod_base = OTHER; note = 2'-O-methyl-adenosine
  modified_base 21: mod_base = OTHER; note = 2'-O-methyl-adenosine
cttttccaaagtgccttaaaa

SEQ ID NO: 616 - RNA, 21 nt, synthetic construct
  source 1..21: mol_type = other RNA
  modified_base <1: mod_base = OTHER; note = two inverted abasic nucleosides
  modified_base 1: mod_base = cm
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = gm
  modified_base 4: mod_base = um
  modified_base 5: mod_base = OTHER; note = 2'-O-methyl-adenosine
  modified_base 6: mod_base = um
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = OTHER; note = 2'-Fluoro-guanosine
  modified_base 11: mod_base = OTHER; note = 2'-Fluoro-guanosine
  modified_base 12: mod_base = OTHER; note = 2'-Fluoro-adenosine
  modified_base 13: mod_base = gm
  modified_base 14: mod_base = gm
  modified_base 15: mod_base = um
  modified_base 16: mod_base = gm
  modified_base 17: mod_base = um
  modified_base 18: mod_base = cm
  modified_base 19: mod_base = um
  modified_base 20: mod_base = cm
  modified_base 21: mod_base = um
cagtattttggaggtgtctct

SEQ ID NO: 617 - RNA, 21 nt, synthetic construct
  source 1..21: mol_type = other RNA
  modified_base <1: mod_base = OTHER; note = two inverted abasic nucleosides
  modified_base 1: mod_base = cm
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = gm
  modified_base 4: mod_base = um
  modified_base 5: mod_base = OTHER; note = 2'-O-methyl-adenosine
  modified_base 6: mod_base = um
  modified_base 7: mod_base = um
  modified_base 8: mod_base = um
  modified_base 9: mod_base = OTHER; note = 2'-Fluoro-uridine
  modified_base 10: mod_base = OTHER; note = 2'-Fluoro-guanosine
  modified_base 11: mod_base = OTHER; note = 2'-Fluoro-guanosine
  modified_base 12: mod_base = OTHER; note = 2'-O-methyl-adenosine
  modified_base 13: mod_base = gm
  modified_base 14: mod_base = gm
  modified_base 15: mod_base = um
  modified_base 16: mod_base = gm
  modified_base 17: mod_base = um
  modified_base 18: mod_base = cm
  modified_base 19: mod_base = um
  modified_base 20: mod_base = cm
  modified_base 21: mod_base = um
cagtattttggaggtgtctct

SEQ ID NO: 618 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = cm
  modified_base 4: mod_base = um
  modified_base 5: mod_base = um
  modified_base 6: mod_base = gm
  modified_base 7: mod_base = OTHER; note = 2'-Fluoro-adenosine
  modified_base 8: mod_base = OTHER; note = 2'-O-methyl-adenosine
  modified_base 9: mod_base = OTHER; note = 2'-Fluoro-uridine
  modified_base 10: mod_base = OTHER; note = 2'-Fluoro-uridine
  modified_base 11: mod_base = OTHER; note = 2'-Fluoro-uridine
  modified_base 12: mod_base = cm
  modified_base 13: mod_base = cm
  modified_base 14: mod_base = um
  modified_base 15: mod_base = OTHER; note = 2'-O-methyl-adenosine
  modified_base 16: mod_base = um
  modified_base 17: mod_base = gm
  modified_base 18: mod_base = um
  modified_base 19: mod_base = OTHER; note = 2'-O-methyl-adenosine
  modified_base 20: mod_base = um
  modified_base 21: mod_base = um
aacttgaatttcctatgtatt

SEQ ID NO: 619 - RNA, 21 nt, synthetic construct
  source 1..21: mol_type = other RNA
  modified_base 1: mod_base = um
  modified_base 1^2: mod_base = OTHER; note = Phosphorothioate bond
  modified_base 2: mod_base = cm
  modified_base 2^3: mod_base = OTHER; note = Phosphorothioate bond
  modified_base 3: mod_base = OTHER; note = 2'-O-methyl-adenosine
  modified_base 4: mod_base = OTHER; note = 2'-O-methyl-adenosine
  modified_base 5: mod_base = um
  modified_base 6: mod_base = gm
  modified_base 7: mod_base = OTHER; note = 2'-Fluoro-guanosine
  modified_base 8: mod_base = OTHER; note = 2'-O-methyl-adenosine
  modified_base 9: mod_base = OTHER; note = 2'-Fluoro-uridine
  modified_base 10: mod_base = OTHER; note = 2'-Fluoro-uridine
  modified_base 11: mod_base = OTHER; note = 2'-Fluoro-uridine
  modified_base 12: mod_base = cm
  modified_base 13: mod_base = cm
  modified_base 14: mod_base = um
  modified_base 15: mod_base = OTHER; note = 2'-O-methyl-adenosine
  modified_base 16: mod_base = OTHER; note = 2'-O-methyl-adenosine
  modified_base 17: mod_base = um
  modified_base 18: mod_base = OTHER; note = 2'-O-methyl-adenosine
  modified_base 19: mod_base = OTHER; note = 2'-O-methyl-adenosine
  modified_base 20: mod_base = um
  modified_base 21: mod_base = um
tcaatggatttcctaataatt

SEQ ID NO: 620 - RNA, 21 nt, synthetic construct
  source 1..21: mol_type = other RNA
  modified_base 1: mod_base = gm
  modified_base 1^2: mod_base = OTHER; note = Phosphorothioate bond
  modified_base 2: mod_base = um
  modified_base 2^3: mod_base = OTHER; note = Phosphorothioate bond
  modified_base 3: mod_base = um
  modified_base 4: mod_base = cm
  modified_base 5: mod_base = OTHER; note = 2'-O-methyl-adenosine
  modified_base 6: mod_base = gm
  modified_base 7: mod_base = OTHER; note = 2'-Fluoro-uridine
  modified_base 8: mod_base = OTHER; note = 2'-O-methyl-adenosine
  modified_base 9: mod_base = OTHER; note = 2'-Fluoro-uridine
  modified_base 10: mod_base = OTHER; note = 2'-Fluoro-uridine
  modified_base 11: mod_base = OTHER; note = 2'-Fluoro-uridine
  modified_base 12: mod_base = um
  modified_base 13: mod_base = gm
  modified_base 14: mod_base = gm
  modified_base 15: mod_base = OTHER; note = 2'-O-methyl-adenosine
  modified_base 16: mod_base = gm
  modified_base 17: mod_base = gm
  modified_base 18: mod_base = um
  modified_base 19: mod_base = gm
  modified_base 20: mod_base = um
  modified_base 21: mod_base = cm
gttcagtattttggaggtgtc

SEQ ID NO: 621 - RNA, 21 nt, synthetic construct
  source 1..21: mol_type = other RNA
  modified_base 1: mod_base = OTHER; note = 2'-O-methyl-adenosine
  modified_base 1^2: mod_base = OTHER; note = Phosphorothioate bond
  modified_base 2: mod_base = OTHER; note = 2'-O-methyl-adenosine
  modified_base 2^3: mod_base = OTHER; note = Phosphorothioate bond
  modified_base 3: mod_base = um
  modified_base 4: mod_base = gm
  modified_base 5: mod_base = gm
  modified_base 6: mod_base = OTHER; note = 2'-O-methyl-adenosine
  modified_base 7: mod_base = OTHER; note = 2'-Fluoro-uridine
  modified_base 8: mod_base = um
  modified_base 9: mod_base = OTHER; note = 2'-Fluoro-uridine
  modified_base 10: mod_base = OTHER; note = 2'-Fluoro-cytidine
  modified_base 11: mod_base = OTHER; note = 2'-Fluoro-cytidine
  modified_base 12: mod_base = um
  modified_base 13: mod_base = OTHER; note = 2'-O-methyl-adenosine
  modified_base 14: mod_base = OTHER; note = 2'-O-methyl-adenosine
  modified_base 15: mod_base = um
  modified_base 16: mod_base = OTHER; note = 2'-O-methyl-adenosine
  modified_base 17: mod_base = OTHER; note = 2'-O-methyl-adenosine
  modified_base 18: mod_base = um
  modified_base 19: mod_base = um
  modified_base 20: mod_base = OTHER; note = 2'-O-methyl-adenosine
  modified_base 21: mod_base = um
aatggatttcctaataattat

SEQ ID NO: 622 - DNA, 21 bp, synthetic construct
  misc_feature 1..21: note = Description of sequence: Description: B4GALT1 siRNA antisense strands (unmodified)
  source 1..21: mol_type = other DNA
  modified_base 4: mod_base = OTHER; note = u
  modified_base 11: mod_base = OTHER; note = u
  modified_base 12: mod_base = OTHER; note = u
acgtgacacgttcggagaatt

SEQ ID NO: 623 - DNA, 21 bp, synthetic construct
  misc_feature 1..21: note = Description of sequence: Description: B4GALT1 siRNA sense strands (unmodified)
  source 1..21: mol_type = other DNA
  modified_base 1: mod_base = OTHER; note = u
  modified_base 2: mod_base = OTHER; note = u
  modified_base 4: mod_base = OTHER; note = u
  modified_base 12: mod_base = OTHER; note = u
  modified_base 14: mod_base = OTHER; note = u
  modified_base 19: mod_base = OTHER; note = u
ttctccgaacgtgtcacgttt

The invention claimed is:

1. A method for treating diabetes in an individual, comprising administering to the individual an inhibitor of expression of B4GALT1, wherein the inhibitor is an siRNA oligomer.

2. The method of claim 1, wherein the siRNA oligomer is conjugated to one or more ligand moieties.

3. The method of claim 2, wherein the one or more ligand moieties comprise one or more GalNAc ligands or one or more GalNAc ligand derivatives.

4. The method of claim 1, wherein the siRNA oligomer has a first and a second strand, and wherein:

i) the first strand of the siRNA oligomer has a length in the range of 15 to 30 nucleosides; and/or ii) the second strand of the siRNA oligomer has a length in the range of 15 to 30 nucleosides.

5. The method of claim 4, wherein the second strand of the siRNA oligomer comprises one or more abasic nucleoside in a terminal region of the second strand, and wherein the one or more abasic nucleoside is connected to an adjacent nucleoside through a reversed internucleoside linkage.

6. The method of claim 5, wherein the second strand of the siRNA oligomer comprises:

i) two or more abasic nucleosides in a terminal region of the second strand;

ii) two or more abasic nucleosides in either the 5' or 3' terminal region of the second strand;

iii) two or more abasic nucleosides in either the 5' or 3' terminal region of the second strand, and wherein the abasic nucleosides are present in an overhang;

iv) two or more consecutive abasic nucleosides in a terminal region of the second strand, and wherein one abasic nucleoside is a terminal nucleoside;

v) two or more consecutive abasic nucleosides in either the 5' or 3' terminal region of the second strand, and wherein one abasic nucleoside is a terminal nucleoside in either the 5' or 3' terminal region of the second strand;

vi) a reversed internucleoside linkage that connects at least one abasic nucleoside to an adjacent basic nucleoside in a terminal region of the second strand;

vii) a reversed internucleoside linkage that connects at least one abasic nucleoside to an adjacent basic nucleoside in either the 5' or 3' terminal region of the second strand;

viii) an abasic nucleoside as the penultimate nucleoside which is connected via the reversed linkage to the nucleoside which is not the terminal nucleoside;

ix) abasic nucleosides as the 2 terminal nucleosides connected via a 5'-3' linkage when reading the strand in the direction towards that terminus;

x) abasic nucleosides as the 2 terminal nucleosides connected via a 3'-5' linkage when reading the strand in the direction towards the terminus comprising the terminal nucleosides;

xi) abasic nucleosides as the terminal 2 positions, wherein the penultimate nucleoside is connected via the reversed linkage to the antepenultimate nucleoside, and wherein the reversed linkage is a 5'-5' reversed linkage or a 3'-3' reversed linkage; and/or xii) abasic nucleosides as the terminal 2 positions, wherein the penultimate nucleoside is connected via the reversed linkage to the antepenultimate nucleoside, and wherein:

(1) the reversed linkage is a 5'-5' reversed linkage and the linkage between the terminal and penultimate abasic nucleosides is 3'-5' when reading towards the terminus comprising the terminal and penultimate abasic nucleosides; or (2) the reversed linkage is a 3'-3' reversed linkage and the linkage between the terminal and penultimate abasic nucleosides is 5'-3' when reading towards the terminus comprising the terminal and penultimate abasic nucleosides.

7. The method of claim 6, wherein the reversed internucleoside linkage is at a terminal region which is distal to the 5' terminal region of the second strand, or at a terminal region which is distal to the 3' terminal region of the second strand.

8. The method of claim 6, wherein the reversed internucleoside linkage is a 3'-3' reversed linkage or a 5'-5' reversed linkage.

9. The method of claim 1, wherein one or more nucleosides on the first strand or the second strand of the nucleic acid are modified.

10. The method of claim 6, wherein the first stand or the second strand of the nucleic acid has a modification at the 2'-OH group of the ribose sugar.

11. The method of claim 10, wherein the modification is a 2'-Me or a 2'-F modification.

12. The method of claim 9, wherein the first strand of the nucleic acid comprises a 2'-F at any of position 14, position 2, position 6, or any combination thereof, counting from position 1 of the first strand of the nucleic acid.

13. The method of claim 9, wherein the second strand of the nucleic acid comprises a 2'-F modification at position 7, 9, 11, and/or 13, counting from position 1 of said second strand of the nucleic acid.

14. The method of claim 9, wherein the first and second strand of the nucleic acid each individually comprise 2'-Me and 2'-F modifications.

15. The method of claim 9, wherein the siRNA oligomer comprises at least one thermally destabilizing modification at one or more of positions 1 to 9 of the first strand counting from position 1 of the first strand, or at one or more of positions on the second strand aligned with positions 1 to 9 of the first strand, and wherein the thermally destabilizing modification is a modified unlocked nucleic acid (UNA) or a glycol nucleic acid (GNA).

16. The method of claim 15, wherein the siRNA oligomer comprises at least one thermally destabilizing modification at position 7 of the first strand, counting from position 1 of the first strand.

17. The method of claim 9, wherein the siRNA oligomer comprises 3 or more 2'-F modifications at positions 7 to 13 of the second strand.

18. The method of claim 17, wherein the siRNA oligomer comprises 4, 5, 6, or 7 2'-F modifications at positions 7 to 13 of the second strand, counting from position 1 of the second strand.

19. The method of claim 1, wherein the siRNA oligomer is in a pharmaceutical composition comprising the siRNA oligomer and a pharmaceutically acceptable excipient or carrier.

* * * * *